United States Patent
Butler et al.

(10) Patent No.: US 10,494,632 B2
(45) Date of Patent: Dec. 3, 2019

(54) INSULIN-LIKE GROWTH FACTOR BINDING PROTEIN, ACID LABILE SUBUNIT (IGFALS) COMPOSITIONS AND METHODS OF USE THEREOF

(71) Applicant: Alnylam Pharmaceuticals, Inc., Cambridge, MA (US)

(72) Inventors: James Butler, Lynnfield, MA (US); Kevin Fitzgerald, Brookline, MA (US); Gregory Hinkle, Plymouth, MA (US); Brian Bettencourt, Groton, MA (US); Huilei Xu, Boston, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 15/743,349

(22) PCT Filed: Jul. 8, 2016

(86) PCT No.: PCT/US2016/041440
§ 371 (c)(1),
(2) Date: Jan. 10, 2018

(87) PCT Pub. No.: WO2017/011286
PCT Pub. Date: Jan. 19, 2017

(65) Prior Publication Data
US 2018/0201929 A1 Jul. 19, 2018

Related U.S. Application Data

(60) Provisional application No. 62/316,726, filed on Apr. 1, 2016, provisional application No. 62/269,401, filed on Dec. 18, 2015, provisional application No. 62/191,008, filed on Jul. 10, 2015.

(51) Int. Cl.
*C12N 15/11* (2006.01)
*C12N 15/113* (2010.01)
*A61P 5/06* (2006.01)

(52) U.S. Cl.
CPC ............. *C12N 15/113* (2013.01); *A61P 5/06* (2018.01); *C12N 15/1136* (2013.01); *C12N 2310/14* (2013.01); *C12N 2310/315* (2013.01); *C12N 2310/321* (2013.01); *C12N 2310/322* (2013.01); *C12N 2310/3341* (2013.01); *C12N 2310/3515* (2013.01)

(58) Field of Classification Search
None
See application file for complete search history.

(56) References Cited

FOREIGN PATENT DOCUMENTS

WO WO-2014197938 A1 12/2014

OTHER PUBLICATIONS

NCBI Reference Sequence: NM_001146006.1, *Homo sapiens* insulin like growth factor binding protein acid labile subunit (IGFALS), transcript variant 1, mRNA, last updated Jun. 24, 2018, accessed and retrieved from www.ncbi.nlm.nih.gov on Feb. 5, 2019. (Year: 2018).*
Siebel et al., Humanization and Characterization of a Human Growth Hormone Receptor (GHR) Antagonist Antibody RN172, GH and IGF action. Endocrine Society, 2014 URL: http://press.endocrine.org/doi/abs/10.1210/endo-meetings.2014.NP.8.SUN-0629.
Lombardi et al., "Efficacy of the new long-acting formulation of lanreotide (Lanreotide Autogel) in somatostatin analogue-naive patients with acromegaly", J. Endocrinol. Invest. 32: 202-209, 2009.
Amuzie et al., "Suppression of Insulin-Like Growth Factor Acid-Labile Subunit Expression—A Novel Mechanism for Deoxynivalenol-Induced Growth Retardation", Toxicological Sciences, 113(2), 412-421, 2010.
Du et al., "Hypoxia Enhances Protective Effect of Placental-Derived Mesenchymal Stem Cells on Damaged Intestinal Epithelial Cells by Promoting Secretion of Insulin-Like Growth Factor-1", *Int. J. Mol. Sci.*, 15, 1983-2002 (2014).
International Search Report and Written Opinion from PCT/US2016/041440 dated Dec. 5, 2016.
International Preliminary Report on Patentability from PCT/US2017/022390 dated Oct. 2, 2018.
Reynolds et al., "Rational siRNA design for RNA interference," Nature Biotechnology, vol. 22, pp. 326-330, 2004.

* cited by examiner

*Primary Examiner* — Dana H Shin
(74) *Attorney, Agent, or Firm* — McCarter & English, LLP; Maria Laccotripe Zacharakis; Deborah L. Nagle

(57) ABSTRACT

The present invention relates to RNAi agents, e.g., double stranded RNAi agents, targeting the insulin-like growth factor binding protein, acid labile subunit (IGFALS) gene or the insulin-like growth factor 1 (IGF-1) gene, methods of using such double stranded RNAi agents to inhibit expression of an IGFALS gene or an IGF-1 gene, and methods of treating subjects having an IGF system-associated disorder.

22 Claims, 1 Drawing Sheet
Specification includes a Sequence Listing.

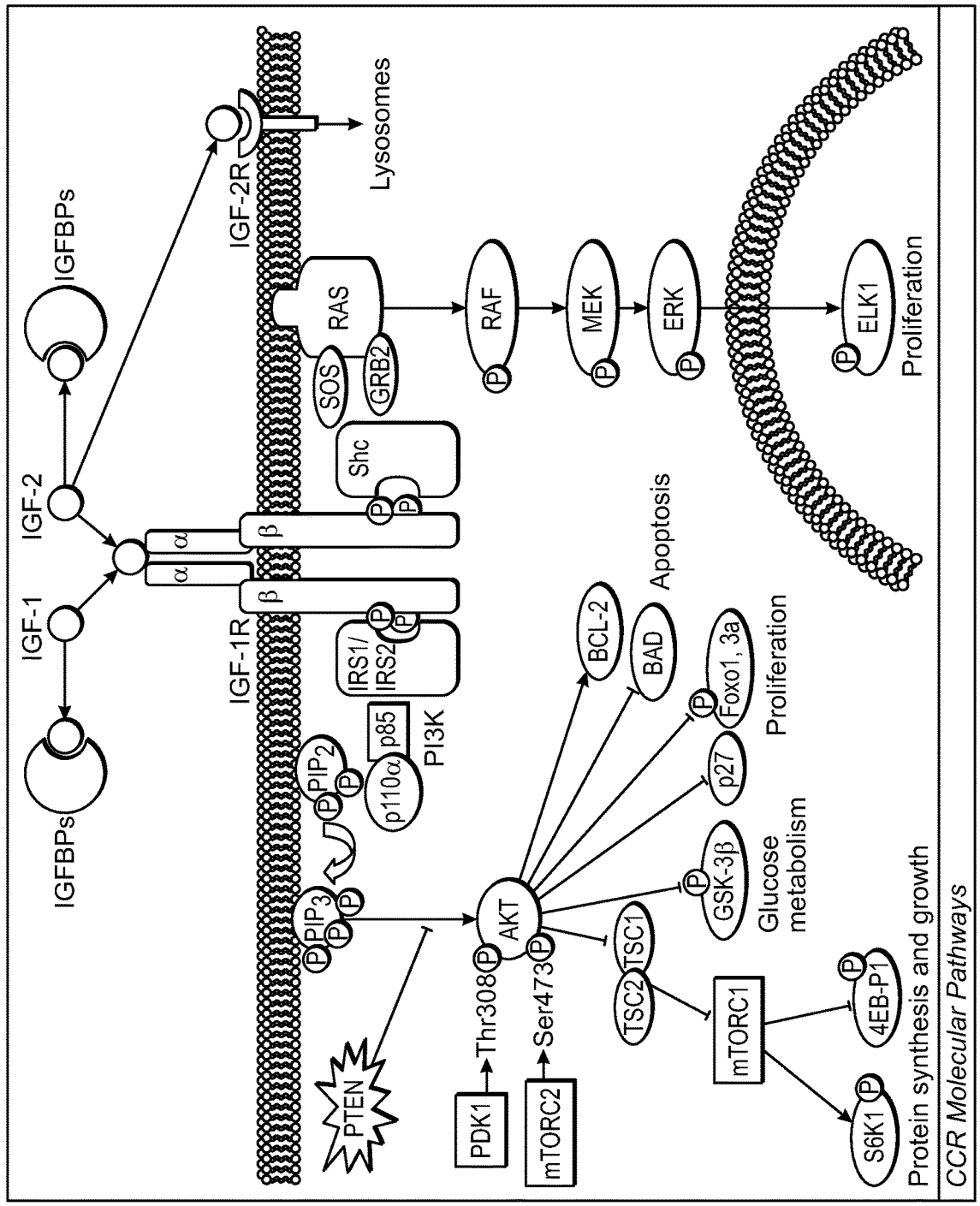

INSULIN-LIKE GROWTH FACTOR BINDING PROTEIN, ACID LABILE SUBUNIT (IGFALS) COMPOSITIONS AND METHODS OF USE THEREOF

RELATED APPLICATION

This application is a 35 U.S.C. § 371 national stage filing of International Application No. PCT/US2016/041440, filed on Jul. 8, 2016, which in turn claims the benefit of priority to U.S. Provisional Patent Application Nos.: 62/191,008, filed on Jul. 10, 2015; 62/269,401, filed on Dec. 18, 2015; and 62/316,726, filed on Apr. 1, 2016. The entire contents of each of the foregoing applications are hereby incorporated herein by reference.

SEQUENCE LISTING

The instant application contains a Sequence Listing which has been submitted electronically in ASCII format and is hereby incorporated by reference in its entirety. The ASCII copy, created on Jul. 7, 2016, is named 121301-03920_SL.txt and is 1,164,878 bytes in size.

BACKGROUND OF THE INVENTION

Acromegaly is a progressive and life threatening disease resulting from growth hormone hypersecretion from a benign pituitary tumor, leading to approximately a 10 year reduction in lifespan and a reduced quality of life. Acromegaly is associated with cardiovascular disease including hypertension and cardiac hypertrophy, cerebrovascular disease including stroke, metabolic disease including diabetes, and respiratory disease including sleep apnea. Mortality rates in acromegaly are correlated with growth hormone and IGF-1 levels, with increased growth hormone concentrations being associated with shorter life spans (Holdaway et al., JCEM, 2004). The clinical features most commonly associated with acromegaly are acral enlargement, maxofacial changes, excessive sweating, athralgias, headache, hypogonadal symptoms, visual deficit, fatigue, weight gain, and galactorrhea. Such symptoms may be associated with any of a number of diseases or conditions and, thus, diagnosis of acromegaly often does not occur until several years after the initiation of growth hormone hypersecretion. Definitive diagnosis of acromeagly includes detection of an increased level of insulin-like growth factor-1 (IGF-1) and growth hormone elevation in an oral glucose tolerance test, confirmed by detection of a GH-hypersecreting pituitary tumor, typically by MRI. (The diagnostic criteria for acromegaly are provided in the American Association of Clinical Endocrinologists Medical Guidelines for Clinical Practice for the Diagnosis and Treatment of Acromegaly-2011 Update (Katznelson et al., Endocr. Pract. 17 (Suppl. 4)).

Current treatment options for acromegaly are insufficient for many patients. Surgical removal of the pituitary adenoma by transsphenoidal surgery results in a cure for about 50-60% of patients. Subjects for whom surgical intervention is not possible or does not result in a cure are treated with first-line pharmacological therapy which includes dopamine agonists or sustained-release somatostatin analogs (SSAs). This therapy results in good control for the disease for about 70% of these patients for whom surgery cannot provide a cure. The use of SSAs, however, is limited to subjects expressing a somatostatin receptor on their tumor. Subjects whose disease cannot be controlled by the first-line pharmacological therapy are treated with SOMAVERT® (pegvisomant), a growth hormone receptor antagonist, which is administered by daily subcutaneous injection. Radiotherapy, which suffers from low efficacy and high side effects, is used as a last resort.

The insulin-like growth factor system is also associated with abnormal growth in cancer and metastasis (see, e.g., Samani et al., Endocrine Rev., 2007). The IGF system has become a target for anticancer agents, both as primary and adjunctive therapy.

Currently, treatments for acromegaly and cancer do not fully meet patient needs. Therefore, there is a need for therapies for subjects suffering from acromegaly or cancer.

SUMMARY OF THE INVENTION

The present invention provides iRNA compositions which affect the RNA-induced silencing complex (RISC)-mediated cleavage of RNA transcripts of an insulin-like growth factor binding protein, acid labile subunit (IGFALS) gene or an insulin-like growth factor-1 (IGF-1) gene. The IGFALS gene or IGF-1 gene may be within a cell, e.g., a cell within a subject, such as a human.

In an aspect, the invention provides a double stranded ribonucleic acid interference (dsRNA) agent for inhibiting expression of insulin-like growth factor binding protein, acid labile subunit (IGFALS), wherein the double stranded dsRNA agent comprises a sense strand and an antisense strand, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:2.

In certain embodiments, the sense strands and antisense strands comprise sequences selected from any one of the sequences in any one of Tables 3, 5, 6, 8, 12, or 14.

In an aspect, the invention provides a double stranded ribonucleic acid interference (dsRNAi) agent for inhibiting expression of insulin-like growth factor-1 (IGF-1), wherein the double stranded RNAi agent comprises a sense strand and an antisense strand, wherein the sense strand comprises at least 15 contiguous nucleotides differing by no more than 3 nucleotides from the nucleotide sequence of SEQ ID NO: 11 or 13 and the antisense strand comprises at least 15 contiguous nucleotides differing by no more than 3 nucleotides from the nucleotide sequence of SEQ ID NO: 12 or 14.

In certain embodiments, the sense strands and antisense strands comprise sequences selected from any one of the sequences in any one of Tables 9, 11, 15, 17, 18, or 20.

In an aspect, the invention provides a double stranded ribonucleic acid interference (dsRNAi) agent for inhibiting expression of insulin-like growth factor binding protein, acid labile subunit (IGFALS), wherein the double stranded RNAi comprises a sense strand and an antisense strand, the antisense strand comprising a region of complementarity which comprises at least 15 contiguous nucleotides differing by no more than 3 nucleotides from any one of the antisense sequences listed in any one of Tables 3, 5, 6, 8, 12, or 14.

In an aspect, the invention provides a double stranded ribonucleic acid interference (dsRNAi) agent for inhibiting expression of insulin-like growth factor 1 (IGF-1) wherein the double stranded RNAi comprises a sense strand and an antisense strand, the antisense strand comprising a region of complementarity which comprises at least 15 contiguous nucleotides differing by no more than 3 nucleotides from any one of the antisense sequences listed in any one of Tables 9, 11, 15, 17, 18, or 20.

In certain embodiments, the double stranded RNAi comprises at least one modified nucleotide. In some embodiments, substantially all of the nucleotides of the sense strand are modified nucleotides. In some embodiments, substantially all of the nucleotides of the antisense strand are modified nucleotides. In some embodiments, all of the nucleotides of the sense strand and all of the nucleotides of the antisense strand comprise a modification.

In an aspect, the invention provides a double stranded RNAi agent for inhibiting expression of insulin-like growth factor binding protein, acid labile subunit (IGFALS), wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:2, wherein substantially all of the nucleotides of the sense strand and substantially all of the nucleotides of the antisense strand are modified nucleotides, and wherein the double stranded RNAi agent comprises a ligand, e.g., the sense strand of the double stranded RNAi agent is conjugated to a ligand, e.g., a ligand is attached at the 3'-terminus of the sense strand.

In an aspect, the invention provides a double stranded ribonucleic acid (RNAi) agent for inhibiting expression of insulin-like growth factor 1 (IGF-1), wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO: 11 or 13 and the antisense strand comprises at least 15 contiguous nucleotides differing by no more than 3 nucleotides from the nucleotide sequence of SEQ ID NO: 12 or 14, wherein substantially all of the nucleotides of the sense strand and substantially all of the nucleotides of the antisense strand are modified nucleotides, and wherein the sense strand is conjugated to a ligand attached at the 3'-terminus.

Accordingly, in certain embodiments, the present invention provides double stranded RNAi agents for inhibiting expression of IGFALS, which comprise a sense strand and an antisense strand forming a double stranded region, wherein the sense strand comprises at least 15 contiguous nucleotides differing by no more than 3 nucleotides from nucleotides 11-62, 24-62, 79-117, 79-130, 155-173, 194-216, 194-229, 211-229, 232-293, 254-272, 310-328, 310-349, 324-345, 331-349, 353-371, 353-394, 376-394, 407-425, 439-449, 431-470, 484-515, 497-515, 541-580, 547-568, 596-647, 616-634, 673-691, 694-712, 694-734, 777-799, 781-799, 825-843, 825-855, 869-922, 958-976, 958-988, 1064-1085, 1064-1096, 1067-1085, 1067-1096, 1100-1141, 1111-1129, 1145-1163, 1145-1186, 1159-1186, 1168-1196, 1168-1214, 1193-1214, 1266-1307, 1321-1339, 1342-1373, 1375-1406, 1432-1450, 1454-1472, 1519-1537, 1519-1559, 1534-1555, 1541-1559, 1606-1624, 1606-1637, 1613-1635, 1672-1690, 1672-1712, 1749-1779, 1783-1801, 1805-1823, 1806-1829, 1871-1889, 1871-1919, 1949-1977, 1993-2011, 2013-2042, 2048-2077, 2048-2088, or 2052-2084 of SEQ ID NO: 1, and, in certain embodiments, the antisense strand comprises at least 15 contiguous nucleotides differing by no more than 3 nucleotides from the corresponding position of the nucleotide sequence of SEQ ID NO: 2 such that the antisense strand is complementary to the at least 15 contiguous nucleotides differing by no more than 3 nucleotides in the sense strand.

Accordingly, in certain embodiments, the present invention provides double stranded RNAi agents for inhibiting expression of insulin-like growth factor 1 (IGF-1), which comprise a sense strand and an antisense strand forming a double stranded region, wherein the sense strand comprises at least 15 contiguous nucleotides differing by no more than 3 nucleotides from nucleotides 330-369, 342-369, 432-490, 432-482, 436-462, 534-559, 330-350, 342-362, 348-368, 349-369, 432-452, 435-455, 436-456, 438-458, 440-460, 441-461, 442-462, 449-469, 455-475, 460-480, 461-481, 462-482, 464-484, 470-490, 484-501, 534-554, 536-556, 538-558, 539-559, 542-562, 548-568, 577-597, 582-602, or 640-660 of the nucleotide sequence of SEQ ID NO: 11, and the antisense strand comprises at least 15 contiguous nucleotides differing by no more than 3 nucleotides from the corresponding position of the nucleotide sequence of SEQ ID NO: 12 such that the antisense strand is complementary to the at least 15 contiguous nucleotides differing by no more than 3 nucleotides in the sense strand.

In certain embodiments, the present invention provides double stranded RNAi agents for inhibiting expression of insulin-like growth factor 1 (IGF-1), which comprise a sense strand and an antisense strand forming a double stranded region, wherein the sense strand comprises at least 15 contiguous nucleotides differing by no more than 3 nucleotides from nucleotides 6-90, 127-145, 185-238, 247-265, 277-295, 389-417, 430-480, 543-561, 654-690, 750-768, 774-870, 894-930, 1007-1029, 1075-1126, 1144-1162, 1197-1215, 1232-1250, 1293-1311, 1334-1352, 1388-1458, 1463-1490, 1511-1529, 1599-1617, 1643-1661, 1690-1727, 1793-1825, 1843-1861, 2057-2075, 2090-2130, 2192-2228, 2310-2332, 2357-2375, 2521-2539, 2566-2588, 2648-2684, 2793-2811, 2962-2980, 3120-3142, 3208-3233, 3269-3287, 3417-3435, 3449-3467, 3575-3603, 3686-3704, 3721-3739, 3806-3824, 3939-3957, 3982-4018, 4081-4037, 4154-4172, 4271-4289, 4319-4377, 4436-4478, 4484-4502, 4523-4545, 4566-4584, 4610-4660, 4686-4717, 4734-4769, 4780-4798, 4815-4843, 4884-4902, 4911-4929, 5004-5034, 5050-5068, 5171-5256, 5311-5364, 5409-5430, 5551-5588, 5609-5638, 5694-5712, 5715-5758, 5790-5808, 5906-5928, 5934-5952, 6323-6345, 6399-6417, 6461-6497, 6510-6535, 6584-6612, 6629-6647, 6661-6683, 6726-6789, 6796-6824, 6826-6851, 6858-6905, 6910-6927, 7004-7022, 7035-7130, 7144-7162, 7175-7241, and 7252-7270 of the nucleotide sequence of SEQ ID NO: 13, and the antisense strand comprises at least 15 contiguous nucleotides differing by no more than 3 nucleotides from the corresponding position of the nucleotide sequence of SEQ ID NO: 14 such that the antisense strand is complementary to the at least 15 contiguous nucleotides differing by no more than 3 nucleotides in the sense strand.

In certain embodiments, the sense strand comprises at least 15 contiguous nucleotides differing by no more than 3 nucleotides from nucleotides 342-369, 432-462, 330-350, 342-362, 348-368, 349-369, 432-452, 435-455, 436-456, 438-458, 440-460, 442-462, 470-490, 481-501, 536-556, or 539-559 of the nucleotide sequence of SEQ ID NO: 11 and the antisense strand comprises at least 15 contiguous nucleotides differing by no more than 3 nucleotides from the corresponding position of the nucleotide sequence of SEQ ID NO: 12 such that the antisense strand is complementary to the at least 15 contiguous nucleotides differing by no more than 3 nucleotides in the sense strand. In certain embodiments, the sense strand comprises at least 15 contiguous nucleotides differing by no more than 3 nucleotides from nucleotides 340-369, 430-490, 430-482, 434-460, 532-559, 328-350, 340-362, 346-368, 347-369, 430-452, 433-455, 434-456, 436-458, 438-460, 439-461, 440-462, 447-469, 453-475, 458-480, 459-481, 460-482, 461-483, 462-484, 468-490, 479-501, 532-554, 534-556, 536-558, 537-559, 540-562, 546-568, 575-597, 580-602, or 638-660 of the nucleotide sequence of SEQ ID NO: 11, for example nucleotides 342-369, 432-462, 330-350, 342-362, 348-368, 349-369, 432-452, 435-455, 436-456, 438-458, 440-460, 442-462, 470-490, 481-501, 536-556, or 539-559 of the nucleotide sequence of SEQ ID NO: 11, and the antisense strand comprises at least 15 contiguous nucleotides differing by no more than 3 nucleotides from the corresponding position of the nucleotide sequence of SEQ ID NO: 12 such that the antisense strand is complementary to the at least 15 contiguous nucleotides differing by no more than 3 nucleotides in the sense strand.

In certain embodiments, the sense strand comprises at least 15 contiguous nucleotides differing by no more than 3 nucleotides from nucleotides 6-90, 127-145, 185-238, 247-265, 277-295, 389-417, 430-480, 543-561, 654-690, 750-768, 774-870, 894-930, 1007-1029, 1075-1126, 1144-1162, 1197-1215, 1232-1250, 1293-1311, 1334-1352, 1388-1458, 1463-1490, 1511-1529, 1599-1617, 1643-1661, 1690-1727, 1793-1825, 1843-1861, 2057-2075, 2090-2130, 2192-2228, 2310-2332, 2357-2375, 2521-2539, 2566-2588, 2648-2684, 2793-2811, 2962-2980, 3120-3142, 3208-3233, 3269-3287, 3417-3435, 3449-3467, 3575-3603, 3686-3704, 3721-3739, 3806-3824, 3939-3957, 3982-4018, 4081-4037, 4154-4172, 4271-4289, 4319-4377, 4436-4478, 4484-4502, 4523-4545, 4566-4584, 4610-4660, 4686-4717, 4734-4769, 4780-4798, 4815-4843, 4884-4902, 4911-4929, 5004-5034, 5050-5068, 5171-5256, 5311-5364, 5409-5430, 5551-5588, 5609-5638, 5694-5712, 5715-5758, 5790-5808, 5906-5928, 5934-5952, 6323-6345, 6399-6417, 6461-6497, 6510-6535, 6584-6612, 6629-6647, 6661-6683, 6726-6789, 6796-6824, 6826-6851, 6858-6905, 6910-6927, 7004-7022, 7035-7130, 7144-7162, 7175-7241, or 7252-7270 of the nucleotide sequence of SEQ ID NO: 13, and the antisense strand comprises at least 15 contiguous nucleotides differing by no more than 3 nucleotides from the corresponding position of the nucleotide sequence of SEQ ID NO: 14 such that the antisense strand is complementary to the at least 15 contiguous nucleotides differing by no more than 3 nucleotides in the sense strand.

In certain embodiments, substantially all of the nucleotides of the sense strand are modified. In certain embodiments, substantially all of the nucleotides of the antisense strand are modified nucleotides. In certain embodiments, substantially all of the nucleotides of both strands are modified. Further, in certain embodiments, the double stranded RNAi agent comprises a ligand, e.g., the double stranded RNAi agent is conjugated to at least one ligand, wherein the ligand is one or more GalNAc derivatives attached through a monovalent, a bivalent or a trivalent branched linker.

In certain embodiments, the present invention also provides double stranded RNAi agents for inhibiting expression of IGFALS, which comprise a sense strand and an antisense strand forming a double stranded region, wherein the sense strand comprises at least 15 contiguous nucleotides from nucleotides 11-62, 24-62, 79-117, 79-130, 155-173, 194-216, 194-229, 211-229, 232-293, 254-272, 310-328, 310-349, 324-345, 331-349, 353-371, 353-394, 376-394, 407-425, 439-449, 431-470, 484-515, 497-515, 541-580, 547-568, 596-647, 616-634, 673-691, 694-712, 694-734, 777-799, 781-799, 825-843, 825-855, 869-922, 958-976, 958-988, 1064-1085, 1064-1096, 1067-1085, 1067-1096, 1100-1141, 1111-1129, 1145-1163, 1145-1186, 1159-1186, 1168-1196, 1168-1214, 1193-1214, 1266-1307, 1321-1339, 1342-1373, 1375-1406, 1432-1450, 1454-1472, 1519-1537, 1519-1559, 1534-1555, 1541-1559, 1606-1624, 1606-1637, 1613-1635, 1672-1690, 1672-1712, 1749-1779, 1783-1801, 1805-1823, 1806-1829, 1871-1889, 1871-1919, 1949-1977, 1993-2011, 2013-2042, 2048-2077, 2048-2088, or 2052-2084 of the nucleotide sequence of SEQ ID NO:1, and the antisense strand comprises at least 15 contiguous nucleotides from the corresponding position of the nucleotide sequence of SEQ ID NO: 2 such that the antisense strand is complementary to the at least 15 contiguous nucleotides in the sense strand.

In certain embodiments, the present invention provides double stranded ribonucleic acid (RNAi) agent for inhibiting expression of insulin-like growth factor 1 (IGF-1), which comprise a sense strand and an antisense strand forming a double stranded region, wherein the sense strand comprises at least 15 contiguous nucleotides selected from the group consisting of nucleotides 330-369, 342-369, 432-490, 432-482, 436-462, 534-559, 330-350, 342-362, 348-368, 349-369, 432-452, 435-455, 436-456, 438-458, 440-460, 441-461, 442-462, 449-469, 455-475, 460-480, 461-481, 462-482, 464-484, 470-490, 484-501, 534-554, 536-556, 538-558, 539-559, 542-562, 548-568, 577-597, 582-602, or 640-660 of the nucleotide sequence of SEQ ID NO: 11 and the antisense strand comprises at least 15 contiguous nucleotides from the corresponding position of the nucleotide sequence of SEQ ID NO: 12 such that the antisense strand is complementary to the at least 15 contiguous nucleotides in the sense strand.

In certain embodiments, the present invention provides double stranded RNAi agents for inhibiting expression of insulin-like growth factor 1 (IGF-1), which comprise a sense strand and an antisense strand forming a double stranded region, wherein the sense strand comprises at least 15 contiguous nucleotides differing by no more than 3 nucleotides from nucleotides 6-90, 127-145, 185-238, 247-265, 277-295, 389-417, 430-480, 543-561, 654-690, 750-768, 774-870, 894-930, 1007-1029, 1075-1126, 1144-1162, 1197-1215, 1232-1250, 1293-1311, 1334-1352, 1388-1458, 1463-1490, 1511-1529, 1599-1617, 1643-1661, 1690-1727, 1793-1825, 1843-1861, 2057-2075, 2090-2130, 2192-2228, 2310-2332, 2357-2375, 2521-2539, 2566-2588, 2648-2684, 2793-2811, 2962-2980, 3120-3142, 3208-3233, 3269-3287, 3417-3435, 3449-3467, 3575-3603, 3686-3704, 3721-3739, 3806-3824, 3939-3957, 3982-4018, 4081-4037, 4154-4172, 4271-4289, 4319-4377, 4436-4478, 4484-4502, 4523-4545, 4566-4584, 4610-4660, 4686-4717, 4734-4769, 4780-4798, 4815-4843, 4884-4902, 4911-4929, 5004-5034, 5050-5068, 5171-5256, 5311-5364, 5409-5430, 5551-5588, 5609-5638, 5694-5712, 5715-5758, 5790-5808, 5906-5928, 5934-5952, 6323-6345, 6399-6417, 6461-6497, 6510-6535, 6584-6612, 6629-6647, 6661-6683, 6726-6789, 6796-6824, 6826-6851, 6858-6905, 6910-6927, 7004-7022, 7035-7130, 7144-7162, 7175-7241, and 7252-7270 of the nucleotide sequence of SEQ ID NO: 13, and the antisense strand comprises at least 15 contiguous nucleotides differing by no more than 3 nucleotides from the corresponding position of the nucleotide sequence of SEQ ID NO: 14 such that the antisense strand is complementary to the at least 15 contiguous nucleotides differing by no more than 3 nucleotides in the sense strand.

In certain embodiments, the agents comprise a sense strand and an antisense strand forming a double stranded region, wherein the sense strand comprises at least 15 contiguous nucleotides selected from the group of nucleotides 342-369, 432-462, 330-350, 342-362, 348-368, 349-369, 432-452, 435-455, 436-456, 438-458, 440-460, 442-462, 470-490, 481-501, 536-556, or 539-559 of the nucleotide sequence of SEQ ID NO:11 and the antisense strand comprises at least 15 contiguous nucleotides from the corresponding position of the nucleotide sequence of SEQ ID NO: 12 such that the antisense strand is complementary to the at least 15 contiguous nucleotides in the sense strand.

In certain embodiments, the agents comprise a sense strand and an antisense strand forming a double stranded region, wherein the sense strand comprises at least 15 contiguous nucleotides selected from the group of nucleotides 340-369, 430-490, 430-482, 434-460, 532-559, 328-350, 340-362, 346-368, 347-369, 430-452, 433-455, 434-456, 436-458, 438-460, 439-461, 440-462, 447-469, 453-475, 458-480, 459-481, 460-482, 461-483, 462-484, 468-490, 479-501, 532-554, 534-556, 536-558, 537-559, 540-562, 546-568, 575-597, 580-602, or 638-660 of the nucleotide sequence of SEQ ID NO: 11, for example nucleotides 342-369, 432-462, 330-350, 342-362, 348-368, 349-369, 432-452, 435-455, 436-456, 438-458, 440-460, 442-462, 470-490, 481-501, 536-556, or 539-559 of the nucleotide sequence of SEQ ID NO: 11, and the antisense strand comprises at least 15 contiguous nucleotides from the corresponding position of the nucleotide sequence of SEQ ID NO: 12 such that the antisense strand is complementary to the at least 15 contiguous nucleotides in the sense strand.

In certain embodiments, the agents comprise a sense strand and an antisense strand forming a double stranded region, wherein the sense strand comprises at least 15 contiguous nucleotides selected from the group of nucleotides 6-90, 127-145, 185-238, 247-265, 277-295, 389-417, 430-480, 543-561, 654-690, 750-768, 774-870, 894-930, 1007-1029, 1075-1126, 1144-1162, 1197-1215, 1232-1250, 1293-1311, 1334-1352, 1388-1458, 1463-1490, 1511-1529, 1599-1617, 1643-1661, 1690-1727, 1793-1825, 1843-1861, 2057-2075, 2090-2130, 2192-2228, 2310-2332, 2357-2375, 2521-2539, 2566-2588, 2648-2684, 2793-2811, 2962-2980, 3120-3142, 3208-3233, 3269-3287, 3417-3435, 3449-3467, 3575-3603, 3686-3704, 3721-3739, 3806-3824, 3939-3957, 3982-4018, 4081-4037, 4154-4172, 4271-4289, 4319-4377, 4436-4478, 4484-4502, 4523-4545, 4566-4584, 4610-4660, 4686-4717, 4734-4769, 4780-4798, 4815-4843, 4884-4902, 4911-4929, 5004-5034, 5050-5068, 5171-5256, 5311-5364, 5409-5430, 5551-5588, 5609-5638, 5694-5712, 5715-5758, 5790-5808, 5906-5928, 5934-5952, 6323-6345, 6399-6417, 6461-6497, 6510-6535, 6584-6612, 6629-6647, 6661-6683, 6726-6789, 6796-6824, 6826-6851, 6858-6905, 6910-6927, 7004-7022, 7035-7130, 7144-7162, 7175-7241, or 7252-7270 of the nucleotide sequence of SEQ ID NO: 13, and the antisense strand comprises at least 15 contiguous nucleotides from the corresponding position of the nucleotide sequence of SEQ ID NO: 14 such that the antisense strand is complementary to the at least 15 contiguous nucleotides in the sense strand.

In certain embodiments, substantially all of the nucleotides of the sense strand are modified nucleotides. In certain embodiments, substantially all of the nucleotides of the antisense strand are modified nucleotides. In certain embodiments, substantially all of the nucleotides of both strands are modified. In preferred embodiments, the double stranded RNAi agent comprises a ligand, e.g., the double stranded RNAi agent is conjugated to at least one ligand, wherein the ligand is one or more GalNAc derivatives attached through a monovalent, a bivalent or a trivalent branched linker.

In certain embodiments, the sense strand and the antisense strand comprise a region of complementarity which comprises at least 15 contiguous nucleotides differing by no more than 3 nucleotides from any one of the antisense sequences listed in any one of Tables 3, 5, 6, 8, 12, or 14 for IGFALS or any one of Tables 9, 11, 15, 17, 18, or 20 for IGF-1.

For example, in certain embodiments, the sense strand and the antisense strand comprise a region of complementarity which comprises at least 15 contiguous nucleotides differing by no more than 3 nucleotides from any one of the antisense nucleotide sequences selected from the group of the antisense nucleotide sequence of duplexes targeted to IGF selected from the group AD-66722, AD-66748, AD-66746, AD-66747, AD-66733, AD-66752, AD-66739, AD-66738, AD-66725, AD-66740, AD-66750, AD-66729, AD-66745, AD-66749, AD-66720, AD-66724, AD-66726, AD-66766, AD-66761, AD-66755, AD-66751, AD-66719, AD-66727, AD-66744, AD-66760, AD-66753, AD-66721, AD-66716, AD-66743, or AD-66728, AD-77150, AD-77158, AD-74963, AD-77138, AD-75740, AD-74968, AD-74965, AD-75766, AD-75761, AD-75137, AD-74979, AD-74966, AD-75750, AD-77126, AD-74971, AD-74982, AD-77144, AD-77149, AD-75751, AD-75111, AD-77147, AD-74964, AD-74983, AD-75765, AD-74970, AD-75749, AD-77168, AD-77127, AD-75748, AD-75779, AD-75145, AD-74975, AD-77151, AD-75170, AD-75741, AD-75162, AD-74985, AD-75759, AD-75218, AD-74981, AD-75155, AD-74978, AD-77153, AD-75157, AD-75123, AD-75184, AD-77160, AD-75125, AD-75229, AD-77165, AD-75112, AD-75206, AD-75769, AD-75174, AD-75225, AD-75792, AD-75115, AD-74986, AD-77171, AD-75131, AD-77128, AD-75179, AD-75792, AD-77124, AD-75191, AD-75774, AD-75114, AD-74973, AD-77156, AD-75120, AD-75130, AD-74967, AD-75231, AD-74987, AD-77140, AD-74969, AD-75000, AD-75791, AD-75143, AD-77120, AD-77142, AD-75217, AD-75234, AD-75173, AD-75232, AD-75188, AD-75135, AD-75018, AD-77122, AD-75009, AD-75121, AD-75791, AD-77135, AD-75214, AD-74994, AD-75139, AD-75166, AD-75020, AD-77159, AD-75236, AD-77123, AD-77133, AD-74972, AD-75223, AD-75148, AD-75124, AD-75185, AD-75150, AD-74976, AD-74980, AD-75212, AD-75239, AD-75221, AD-75118, AD-75793, AD-75023, AD-75164, AD-74997, AD-74984, AD-75011, AD-75203, AD-77161, AD-75033, AD-75177, AD-75795, AD-77146, AD-75793, AD-75788, AD-75079, AD-75152, AD-77121, AD-75237, AD-75014, AD-75755, AD-75028, AD-75091, AD-75110, AD-75230, AD-75029, AD-75099, AD-77130, AD-75224, AD-75142, AD-75760, AD-75795, AD-77136, AD-75032, AD-75757, AD-75017, AD-75151, AD-75122, AD-75002, AD-75021, AD-75005, AD-75088, AD-75153, AD-75208, AD-74977, AD-75069, AD-75107, AD-74990, AD-75061, AD-75083, AD-75116, AD-75169, AD-75058, AD-74991, AD-75041, AD-77131, AD-75772, AD-77169, AD-75133, AD-75222, AD-75007, AD-75101, AD-77137, AD-75090, AD-77148, AD-75008, AD-77134, AD-74999, AD-75048, AD-75095, AD-74974, AD-75788, AD-75057, AD-75113, AD-77172, AD-75016, AD-75186, AD-75205, AD-75238, or AD-75146; for example duplexes AD-66722, AD-66748, AD-66746, AD-66747, AD-66733, AD-66752, AD-66739, AD-66738, AD-66725, AD-66740, AD-66750, AD-66729, or AD-66745. In certain embodiments, nucleotide sequences selected from the group duplexes targeted to IGF selected from the group AD-66722, AD-66748, AD-66746, AD-66747, AD-66733, AD-66752, AD-66739, AD-66738, AD-66725, AD-66740, AD-66750, AD-66729, and AD-66745. In certain embodiments, the sense strand and the antisense strand comprise a region of complementarity which comprises at least 15 contiguous nucleotides of any one of the sense and antisense nucleotide sequences of the foregoing duplexes.

In certain embodiments, the sense strand and the antisense strand comprise a region of complementarity which comprises at least 15 contiguous nucleotides differing by no more than 3 nucleotides from any one of the antisense sequences of the duplexes targeted to IGFALS selected from the group AD-62728, AD-62734, AD-68111, AD-68709, AD-68712, AD-68715, AD-68716, AD-68717, AD-68719, AD-68720, AD-68722, AD-68725, AD-68726, AD-68730, AD-68731, AD-73782, AD-73773, AD-73765, AD-73946, AD-73947, AD-73858, AD-73797, AD-73808, AD-73906, AD-73912, AD-73848, AD-73836, AD-73818, AD-73786, AD-73862, AD-73795, AD-73766, AD-73930, AD-73825, AD-73924, AD-73802, AD-73767, AD-73771, AD-73777, AD-73793, AD-73898, AD-73784, AD-73882, AD-73803, AD-73772, AD-73907, AD-73948, AD-73890, AD-73883, AD-73770, AD-73867, AD-73931, AD-73932, AD-73787, AD-73791, AD-73880, AD-73914, AD-73849, AD-73863, AD-73920, AD-73944, AD-73841, AD-73785, AD-73804, AD-73823, AD-73885, AD-73788, AD-73865, AD-73941, AD-73859, AD-73913, AD-73892, AD-73837, AD-73842, AD-73840, AD-73813, AD-73796, AD-73875, AD-73900, AD-73922, AD-73861, AD-73816, AD-73764, AD-73868, AD-73812, AD-73826, AD-73938, AD-73843, AD-73817, AD-73943, AD-73827, AD-73937, AD-73877, AD-73833, AD-73807, AD-73819, AD-73886, AD-73919, AD-73800, AD-76171, AD-76173, AD-76203, AD-76210, AD-76172, AD-76175, AD-76209, AD-76174, AD-76208, AD-76186, AD-76177, AD-76199, AD-76197, or AD-76212.

In certain embodiments, substantially all of the nucleotides of the sense strand are modified nucleotides. In certain embodiments, substantially all of the nucleotides of the antisense strand are modified nucleotides. In certain embodiments, substantially all of the nucleotides of both strands are modified.

In one embodiment, at least one of the modified nucleotides is selected from the group consisting of a deoxynucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic. In another embodiment, the modified nucleotides comprise a short sequence of 3'-terminal deoxy-thymine nucleotides (dT).

In certain embodiments, substantially all of the nucleotides of the sense strand are modified. In certain embodiments, substantially all of the nucleotides of the antisense strand are modified. In certain embodiments, substantially all of the nucleotides of both the sense strand and the antisense strand are modified.

In certain embodiments, the duplex comprises a modified antisense nucleotide sequence targeted to IGFALS provided in Table 5, 8, or 14, or targeted to IGF-1 in Table 11, 17, or 20. In certain embodiments, the duplex comprises a modified sense strand nucleotide sequence targeted to IGFALS provided in Table 5, 8, or 14, or targeted to IGF-1 in Table 11, 17, or 20. In certain embodiments, the duplex comprises the modified sense strand nucleotide sequence and the modified antisense strand nucleotide of any one of the duplexes targeted to IGFALS provided in Table 5, 8, or 14, or targeted to IGF-1 in Table 11, 17, or 20.

In certain embodiments, the region of complementarity between the antisense strand and the target is at least 17 nucleotides in length. For example, the region of complementarity between the antisense strand and the target is 19 to 21 nucleotides in length, for example, the region of complementarity is 21 nucleotides in length. In preferred embodiments, each strand is no more than 30 nucleotides in length.

In some embodiments, at least one strand comprises a 3' overhang of at least 1 nucleotide, e.g., at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide. In other embodiment, at least one strand comprises a 3' overhang of at least 2 nucleotides.

In many embodiments, the double stranded RNAi agent further comprises a ligand. The ligand may be one or more GalNAc attached to the RNAi agent through a monovalent, a bivalent, or a trivalent branched linker. The ligand may be conjugated to the 3' end of the sense strand of the double stranded RNAi agent. The ligand can be an N-acetylgalactosamine (GalNAc) derivative including, but not limited to

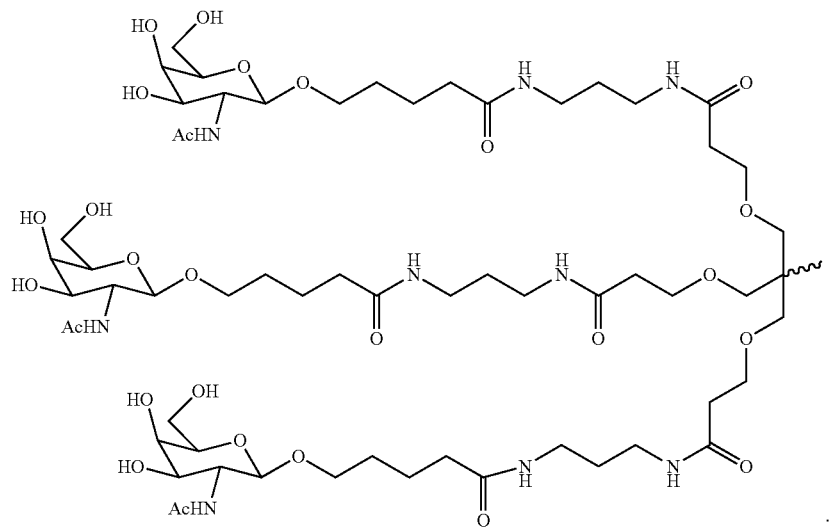 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In various embodiments, the ligand is attached to the 5' end of the sense strand of the double stranded RNAi agent, the 3' end of the antisense strand of the double stranded RNAi agent, or the 5' end of the antisense strand of the double stranded RNAi agent.

In some embodiments, the double stranded RNAi agents of the invention comprise a plurality, e.g., 2, 3, 4, 5, or 6, of GalNAc, each independently attached to a plurality of nucleotides of the double stranded RNAi agent through a plurality of monovalent linkers.

In certain embodiments, the dsRNAi is agent conjugated to the ligand as shown in the following schematic:

13         14
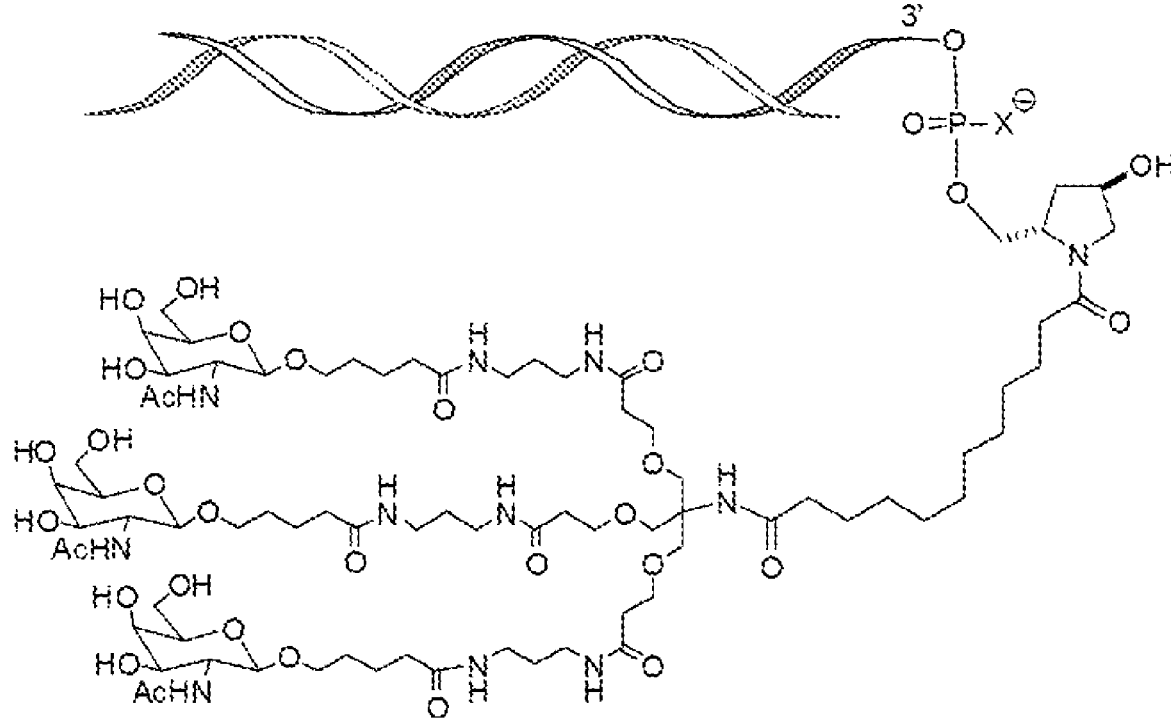

and, wherein X is O or S. In one embodiment, the X is O.

In certain embodiments, the ligand is a cholesterol.

In certain embodiments, the region of complementarity comprises any one of the antisense sequences targeted to IGFALS provided in Table 3, 5, 6, 8, 12, or 14 or targeted to IGF-1 in Table 9, 11, 15, 17, 18, or 20. In another embodiment, the region of complementarity consists of any one of the antisense sequences of targeted to IGFALS provided in Table 3, 5, 6, 8, 12, or 14 or targeted to IGF-1 in Table 9, 11, 15, 17, 18, or 20.

In another aspect, the invention provides a double stranded RNAi agent for inhibiting expression of IGFALS or IGF-1, wherein the double stranded RNAi agent comprises a sense strand complementary to an antisense strand, wherein the antisense strand comprises a region complementary to part of an mRNA encoding IGFALS or IGF-1, wherein each strand is about 14 to about 30 nucleotides in length, wherein the double stranded RNAi agent is represented by formula (III):

sense: 5'$n_p$-$N_a$-(XXX)$_i$-$N_b$-YYY-$N_b$-(ZZZ)$_j$-$N_a$-$n_q$3'

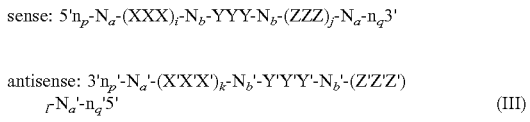

(III)

wherein: i, j, k, and l are each independently 0 or 1; p, p', q, and q' are each independently 0-6; each $N_a$ and $N_a$' independently represents an oligonucleotide sequence comprising 0-25 nucleotides which are either modified or unmodified or combinations thereof, each sequence comprising at least two differently modified nucleotides; each $N_b$ and $N_b$' independently represents an oligonucleotide sequence comprising 0-10 nucleotides which are either modified or unmodified or combinations thereof; each $n_p$, $n_p$', $n_q$, and $n_q$', each of which may or may not be present, independently represents an overhang nucleotide; XXX, YYY, ZZZ, X'X'X', Y'Y'Y', and Z'Z'Z' each independently represent one motif of three identical modifications on three consecutive nucleotides; modifications on $N_b$ differ from the modification on Y and modifications on $N_b$' differ from the modification on Y'; and wherein the double stranded RNAi agent comprises a ligand, e.g., the sense strand is conjugated to at least one ligand.

In certain embodiments, i is 0; j is 0; i is 1; j is 1; both i and j are 0; or both i and j are 1. In another embodiment, k is 0; l is 0; k is 1; l is 1; both k and l are 0; or both k and l are 1. In another embodiment, XXX is complementary to X'X'X', YYY is complementary to Y'Y'Y', and ZZZ is complementary to Z'Z'Z'. In another embodiment, the YYY motif occurs at or near the cleavage site of the sense strand. In another embodiment, the Y'Y'Y' motif occurs at the 11, 12 and 13 positions of the antisense strand from the 5'-end. In one embodiment, the Y' is 2'-O-methyl.

For example, formula (III) can be represented by formula (IIIa):

sense: 5'$n_p$-$N_a$-YYY-$N_a$-$n_q$3' antisense: 3'$n_p$'-$N_a$'-Y'Y'Y'-$N_a$'-$n_q$'5' (IIIa).

In another embodiment, formula (III) is represented by formula (IIIb):

sense: 5'$n_p$-$N_a$-YYY-$N_b$-ZZZ-$N_a$-$n_q$3' antisense: 3'$n_p$'-$N_a$'-Y'Y'Y'-$N_b$'-Z'Z'Z'-$N_a$'-$n_q$'5' (IIIb)

wherein each $N_b$ and $N_b$' independently represents an oligonucleotide sequence comprising 1-5 modified nucleotides.

Alternatively, formula (III) can be represented by formula (IIIc):

sense: 5'$n_p$-$N_a$-XXX-$N_b$-YYY-$N_a$-$n_q$3' antisense: 3'$n_p$'-$N_a$'-X'X'X'-$N_b$'-Y'Y'Y'-$N_a$'-$n_q$'5' (IIIc)

wherein each $N_b$ and $N_b$' independently represents an oligonucleotide sequence comprising 1-5 modified nucleotides.

Further, formula (III) can be represented by formula (IIId):

sense: 5'$n_p$-$N_a$-XXX-$N_b$-YYY-$N_b$-ZZZ-$N_a$-$n_q$3'

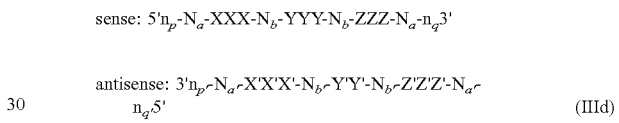

(IIId)

wherein each $N_b$ and $N_b$' independently represents an oligonucleotide sequence comprising 1-5 modified nucleotides and each $N_a$ and $N_a$' independently represents an oligonucleotide sequence comprising 2-10 modified nucleotides.

In certain embodiment, the double stranded region is 15-30 nucleotide pairs in length. For example, the double stranded region can be 17-23 nucleotide pairs in length. The double stranded region can be 17-25 nucleotide pairs in length. The double stranded region can be 23-27 nucleotide pairs in length. The double stranded region can be 19-21 nucleotide pairs in length. The double stranded region can be 21-23 nucleotide pairs in length.

In certain embodiments, each strand has 15-30 nucleotides. In other embodiments, each strand has 19-30 nucleotides.

Modifications on the nucleotides are selected from the group including, but not limited to, LNA, HNA, CeNA, 2'-methoxyethyl, 2'-O-alkyl, 2'-O-allyl, 2'-C-allyl, 2'-fluoro, 2'-deoxy, 2'-hydroxyl, and combinations thereof. In another embodiment, the modifications on the nucleotides are 2'-O-methyl or 2'-fluoro modifications.

In many embodiments, the double stranded RNAi agent further comprises a ligand. The ligand may be one or more GalNAc attached to the RNAi agent through a monovalent, a bivalent, or a trivalent branched linker. The ligand may be conjugated to the 3' end of the sense strand of the double stranded RNAi agent. The ligand can be an N-acetylgalactosamine (GalNAc) derivative including, but not limited to

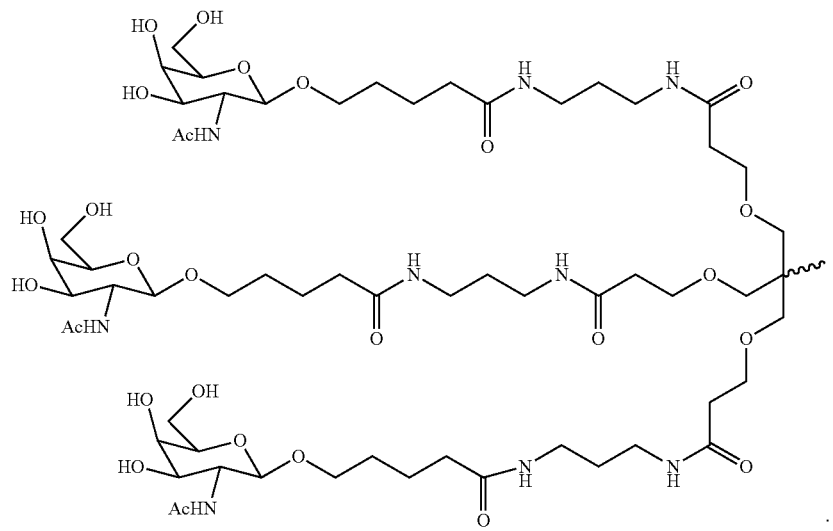 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In various embodiments, the ligand is attached to the 5' end of the sense strand of the double stranded RNAi agent, the 3' end of the antisense strand of the double stranded RNAi agent, or the 5' end of the antisense strand of the double stranded RNAi agent.

In some embodiments, the double stranded RNAi agents of the invention comprise a plurality, e.g., 2, 3, 4, 5, or 6, of GalNAc, each independently attached to a plurality of nucleotides of the double stranded RNAi agent through a plurality of monovalent linkers.

An exemplary structure of a dsRNAi agent conjugated to the ligand is shown in the following schematic

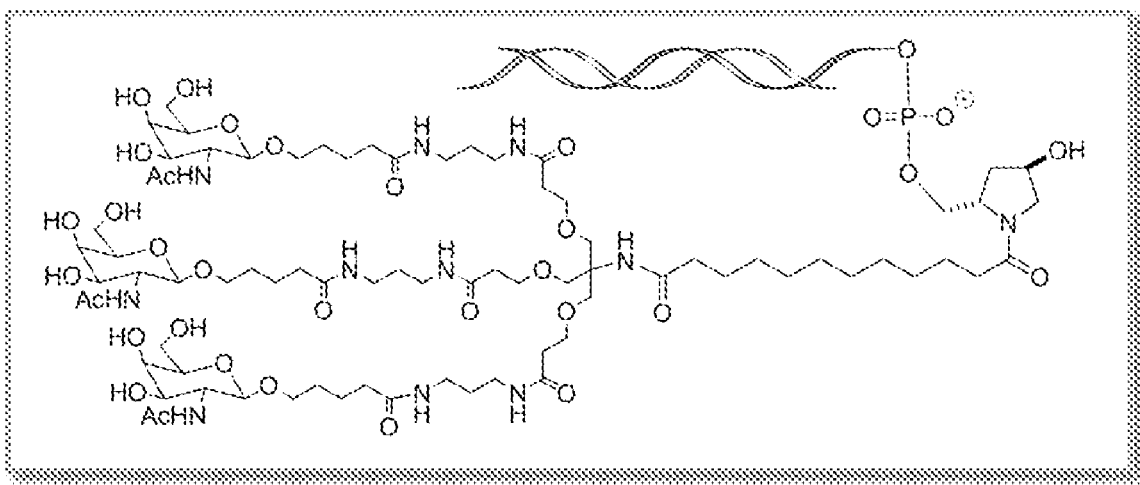

In certain embodiments, the ligand can be a cholesterol.

In certain embodiments, the double stranded RNAi agent further comprises at least one phosphorothioate or methylphosphonate internucleotide linkage. For example the phosphorothioate or methylphosphonate internucleotide linkage can be at the 3'-terminus of one strand, i.e., the sense strand or the antisense strand; or at the ends of both strands, the sense strand and the antisense strand.

In certain embodiments, the phosphorothioate or methylphosphonate internucleotide linkage is at the 5'-terminus of one strand, i.e., the sense strand or the antisense strand; or at the ends of both strands, the sense strand and the antisense strand.

In certain embodiments, the phosphorothioate or methylphosphonate internucleotide linkage is at the both the 5'- and 3'-terminus of one strand, i.e., the sense strand or the antisense strand; or at the ends of both strands, the sense strand and the antisense strand.

In certain embodiments, the base pair at the 1 position of the 5'-end of the antisense strand of the duplex is an AU base pair.

In certain embodiments, the Y nucleotides contain a 2'-fluoro modification. In another embodiment, the Y' nucleotides contain a 2'-O-methyl modification. In another embodiment, p'>0. In some embodiments, p'=2. In some embodiments, q'=0, p=0, q=0, and p' overhang nucleotides are complementary to the target mRNA. In some embodiments, q'=0, p=0, q=0, and p' overhang nucleotides are non-complementary to the target mRNA.

In certain embodiments, the sense strand has a total of 21 nucleotides and the antisense strand has a total of 23 nucleotides.

In certain embodiments, at least one $n_p'$ is linked to a neighboring nucleotide via a phosphorothioate linkage. In other embodiments, all $n_p'$ are linked to neighboring nucleotides via phosphorothioate linkages.

In certain embodiments, the dsRNAi agent is selected from the group of any one of the double stranded RNAi agents targeted to IGFALS provided in Table 3, 5, 6, 8, 12, or 14, or targeted to IGF-1 in Table 9, 11, 15, 17, 18, or 20. In certain embodiments, all of the nucleotides of the sense strand and all of the nucleotides of the antisense strand comprise a modification.

In an aspect, the invention provides a double stranded RNAi agent for inhibiting expression of IGFALS or IGF-1 in a cell, wherein the double stranded RNAi agent comprises a sense strand complementary to an antisense strand, wherein the antisense strand comprises a region complementary to part of an mRNA encoding IGFALS or IGF-1, wherein each strand is about 14 to about 30 nucleotides in length, wherein the double stranded RNAi agent is represented by formula (III):

sense: 5'$n_p$-$N_a$-(XXX)$_i$-$N_b$-YYY-$N_b$-(ZZZ)$_j$-$N_a$-$n_q$3'

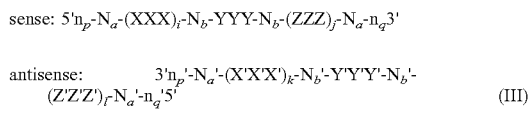

wherein i, j, k, and l are each independently 0 or 1; p, p', q, and q' are each independently 0-6; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; each $n_p$, $n_p'$, $n_q$, and $n_q'$, each of which may or may not be present independently represents an overhang nucleotide; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; and wherein the double stranded RNAi agent comprises a ligand, e.g., the double stranded RNAi agent is conjugated to at least one ligand, wherein the ligand is one or more GalNAc derivatives attached through a monovalent, a bivalent or a trivalent branched linker.

In an aspect, the invention provides a double stranded RNAi agent for inhibiting expression of IGFALS or IGF-1 in a cell, wherein the double stranded RNAi agent comprises a sense strand complementary to an antisense strand, wherein the antisense strand comprises a region complementary to part of an mRNA encoding IGFALS or IGF-1, wherein each strand is about 14 to about 30 nucleotides in length, wherein the double stranded RNAi agent is represented by formula (III):

sense: 5'$n_p$-$N_a$-(XXX)$_i$-$N_b$-YYY-$N_b$-(ZZZ)$_j$-$N_a$-$n_q$3'

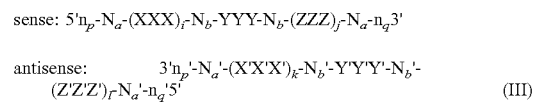

wherein: i, j, k, and l are each independently 0 or 1; each $n_p$, $n_q$, and $n_q'$, each of which may or may not be present, independently represents an overhang nucleotide;

p, q, and q' are each independently 0-6; $n_p'$>0 and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; and wherein the double stranded RNAi agent comprises a ligand, e.g., the double stranded RNAi agent is conjugated to at least one ligand, wherein the ligand is one or more GalNAc derivatives attached through a monovalent, a bivalent or a trivalent branched linker.

In certain embodiments, the invention provides a d double stranded ribonucleic acid (RNAi) agent for inhibiting expression of IGFALS or IGF-1, wherein the double stranded RNAi agent comprises a sense strand complementary to an antisense strand, wherein the antisense strand comprises a region complementary to part of an mRNA encoding IGFALS or IGF-1, wherein each strand is about 14 to about 30 nucleotides in length, wherein the double stranded RNAi agent is represented by formula (III):

sense: 5'$n_p$-$N_a$-(XXX)$_i$-$N_b$-YYY-$N_b$-(ZZZ)$_j$-$N_a$-$n_q$3'

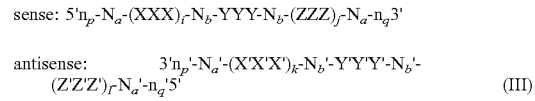

wherein i, j, k, and l are each independently 0 or 1; each $n_p$, $n_q$, and $n_q'$, each of which may or may not be present, independently represents an overhang nucleotide; p, q, and q' are each independently 0-6; $n_p'$>0 and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; and wherein the double stranded RNAi agent is conjugated to at least one ligand, wherein the ligand is one or more GalNAc derivatives attached through a monovalent, a bivalent or a trivalent linker.

In an aspect, the invention provides a double stranded RNAi agent for inhibiting expression of IGFALS or IGF-1, wherein the double stranded RNAi agent comprises a sense strand complementary to an antisense strand, wherein the antisense strand comprises a region complementary to part of an mRNA encoding IGFALS or IGF-1, wherein each strand is about 14 to about 30 nucleotides in length, wherein the double stranded RNAi agent is represented by formula (III):

sense: 5'$n_p$-$N_a$-(XXX)$_i$-$N_b$-YYY-$N_b$-(ZZZ)$_j$-$N_a$-$n_q$3'

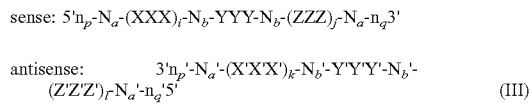

wherein i, j, k, and l are each independently 0 or 1; each $n_p$, $n_q$, and $n_q'$, each of which may or may not be present, independently represents an overhang nucleotide; p, q, and q' are each independently 0-6; $n_p'$>0 and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; wherein the double stranded RNAi agent comprises a ligand, e.g., the double stranded RNAi agent is conjugated to at least one ligand, wherein the ligand is one or more GalNAc derivatives attached through a monovalent, a bivalent or a trivalent branched linker.

In an aspect, the invention provides a double stranded RNAi agent capable of inhibiting the expression of IGFALS or IGF-1 in a cell, wherein the double stranded RNAi agent comprises a sense strand complementary to an antisense strand, wherein the antisense strand comprises a region complementary to part of an mRNA encoding IGFALS of IGF-1, wherein each strand is about 14 to about 30 nucleotides in length, wherein the double stranded RNAi agent is represented by formula (III):

sense: 5'$n_p$-$N_a$-(XXX)$_i$-$N_b$-YYY-$N_b$-(ZZZ)$_j$-$N_a$-$n_q$3'

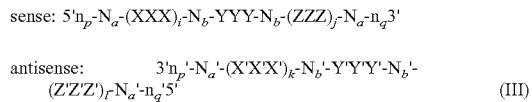

wherein i, j, k, and l are each independently 0 or 1; each $n_p$, $n_q$, and $n_q'$, each of which may or may not be present, independently represents an overhang nucleotide; p, q, and q' are each independently 0-6; $n_p'$>0 and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; wherein the sense strand comprises at least one phosphorothioate linkage; and wherein the double stranded RNAi agent comprises a ligand, e.g., the double stranded RNAi agent is conjugated to at least one ligand, wherein the ligand is one or more GalNAc derivatives attached through a monovalent, a bivalent or a trivalent branched linker.

In an aspect, the invention provides a double stranded RNAi agent for inhibiting expression of IGFALS or IGF-1 in a cell, wherein the double stranded RNAi agent comprises a sense strand complementary to an antisense strand, wherein the antisense strand comprises a region complementary to part of an mRNA encoding IGFALS or IGF-1, wherein each strand is about 14 to about 30 nucleotides in length, wherein the double stranded RNAi agent is represented by formula (III):

sense: 5'$n_p$-$N_a$-YYY-$N_a$-$n_q$3'

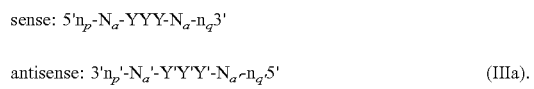

wherein each $n_p$, $n_q$, and $n_q'$, each of which may or may not be present, independently represents an overhang nucleotide; p, q, and q' are each independently 0-6; $n_p'$>0 and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; YYY and Y'Y'Y' each independently represent one motif of three identical modifications on three consecutive nucleotides, and wherein the modifications are 2'-O-methyl or 2'-fluoro modifications; wherein the sense strand comprises at least one phosphorothioate linkage; wherein the double stranded RNAi agent comprises a ligand, e.g., the double stranded RNAi agent is conjugated to at least one ligand, wherein the ligand is one or more GalNAc derivatives attached through a monovalent, a bivalent or a trivalent branched linker.

In an aspect, the invention provides a double stranded ribonucleic acid (RNAi) agent for inhibiting expression of IGFALS, wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:2, wherein substantially all of the nucleotides of the sense strand comprise a modification selected from a 2'-O-methyl modification and a 2'-fluoro modification, wherein the sense strand comprises two phosphorothioate internucleotide linkages at the 5'-terminus, wherein substantially all of the nucleotides of the antisense strand comprise a modification selected from a 2'-O-methyl modification and a 2'-fluoro modification, wherein the antisense strand comprises two phosphorothioate internucleotide linkages at the 5'-terminus and two phosphorothioate internucleotide linkages at the 3'-terminus, and wherein the sense strand is conjugated to one or more GalNAc derivatives attached through a monovalent, a bivalent or a trivalent linker at the 3'-terminus.

In an aspect, the invention provides a double stranded ribonucleic acid (RNAi) agent for inhibiting expression of insulin-like growth factor 1 (IGF-1), wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO:11 or 13 and the antisense strand comprises at least 15 contiguous nucleotides differing by no more than 3 nucleotides from the nucleotide sequence of SEQ ID NO:12 or 14, wherein substantially all of the nucleotides of the sense strand comprise a modification selected from a 2'-O-methyl modification and a 2'-fluoro modification, wherein the sense strand comprises two phosphorothioate internucleotide linkages at the 5'-terminus, wherein substantially all of the nucleotides of the antisense strand comprise a modification selected from a 2'-O-methyl modification and a 2'-fluoro modification, wherein the antisense strand comprises two phosphorothioate internucleotide linkages at the 5'-terminus and two phosphorothioate internucleotide linkages at the 3'-terminus, and wherein the sense strand is conjugated to one or more GalNAc derivatives attached through a monovalent, a bivalent or a trivalent linker at the 3'-terminus.

In certain embodiments, all of the nucleotides of the sense strand and all of the nucleotides of the antisense strand are modified nucleotides. In certain embodiments, each strand has 19-30 nucleotides.

In certain embodiments, substantially all of the nucleotides of the sense strand are modified. In certain embodiments, substantially all of the nucleotides of the antisense strand are modified. In certain embodiments, substantially all of the nucleotides of both the sense strand and the antisense strand are modified.

In an aspect, the invention provides a cell containing the dsRNAi agent as described herein.

In an aspect, the invention provides a vector encoding at least one strand of a dsRNAi agent, wherein the RNAi agent comprises a region of complementarity to at least a part of an mRNA encoding IGFALS or IGF-1, wherein the RNAi is 30 base pairs or less in length, and wherein the RNAi agent targets the mRNA for cleavage. In certain embodiments, the region of complementarity is at least 15 nucleotides in length. In certain embodiments, the region of complementarity is 19 to 23 nucleotides in length.

In an aspect, the invention provides a cell comprising a vector as described herein.

In an aspect, the invention provides a pharmaceutical composition for inhibiting expression of an IGFALS or IGF-1 gene, comprising a double stranded RNAi agent of the invention. In one embodiment, the RNAi agent is administered in an unbuffered solution. In certain embodiments, the unbuffered solution is saline or water. In other embodiments, the RNAi agent is administered with a buffer solution. In such embodiments, the buffer solution can comprise acetate, citrate, prolamine, carbonate, or phosphate, or any combination thereof. For example, the buffer solution can be phosphate buffered saline (PBS).

In an aspect, the invention provides a pharmaceutical composition comprising the double stranded RNAi agent of the invention and a lipid formulation. In certain embodiments, the lipid formulation comprises a LNP. In certain embodiments, the lipid formulation comprises MC3.

In an aspect, the invention provides a method of inhibiting IGFALS or IGF-1 expression in a cell, the method comprising (a) contacting the cell with the double stranded RNAi agent of the invention or a pharmaceutical composition of the invention; and (b) maintaining the cell produced in step (a) for a time sufficient to obtain degradation of the mRNA transcript of an IGFALS or IGF-1 gene, thereby inhibiting expression of the IGFALS or IGF-1 gene in the cell. In certain embodiments, the cell is within a subject, for example, a human subject, for example a female human or a male human. In preferred embodiments, IGFALS or IGF-1 expression is inhibited by at least 30%, 40%, 50%, 60%, 70%, 80%, 90%, or 95%, or to below the threshold of detection of the assay method used. Preferably the expression is inhibited by at least 50%. In some embodiments of the methods of the invention, expression of an IGF-1 gene is inhibited by at least 30%, 40%, 50%, 60%, 70%, 80%, 90%, or 95% of the difference between the elevated level associated with the disease and a normal level in an appropriate control subject. Preferably the elevated level is inhibited by at least 50%.

In an aspect, the invention provides a method of treating a subject having a disease or disorder that would benefit from reduction in IGFALS or IGF-1 expression, such as an IGF system-associated disease or disorder, the method comprising administering to the subject a therapeutically effective amount of a double stranded RNAi agent of the invention or a pharmaceutical composition of the invention, thereby treating the subject.

In an aspect, the invention provides a method of preventing at least one symptom in a subject having a disease or disorder that would benefit from reduction in IGFALS or IGF-1 expression, such as an IGF system-associated disease or disorder, the method comprising administering to the subject a prophylactically effective amount of a double stranded RNAi agent of the invention or a pharmaceutical composition of the invention, thereby preventing at least one symptom in the subject having a disorder that would benefit from reduction in IGFALS or IGF-1 expression.

In certain embodiments, the administration of the double stranded RNAi to the subject causes a decrease in the IGF-1 signaling pathway. In certain embodiments, the administration of the double stranded RNAi causes a decrease in the level of IGF-1 or IGFALS in the subject, e.g., serum levels of IGF-1 or IGFALS in the subject.

In certain embodiments, the IGF system-associated disease is acromegaly. In certain embodiments, the IGF system-associated disease is gigantism. In another embodiment, the IGF system-associated disease is cancer. In certain embodiments, the cancer is metastatic cancer.

In certain embodiments, the invention further comprises administering an inhibitor of growth hormone to a subject with an IGF system-associated disease.

In certain embodiments, the invention further comprises administering an inhibitor of the IGF pathway signaling to a subject with an IGF system-associated disease.

In certain embodiments, wherein the IGF system-associated disease is acromegaly or gigantism, the subject is further treated for acromegaly or gigantism. In certain embodiments, the treatment for acromegaly or gigantism includes surgery. In certain embodiments, the treatment for acromegaly or gigantism includes radiation. In certain embodiments, the treatment for acromegaly or gigantism includes administration of a therapeutic agent.

In certain embodiments, wherein the IGF system-associated disease is cancer, the subject is further treated for cancer. In certain embodiments, the treatment for cancer includes surgery. In certain embodiments, the treatment for cancer includes radiation. In certain embodiments, the treatment for cancer includes administration of a chemotherapeutic agent.

In various embodiments, the dsRNAi agent is administered at a dose of about 0.01 mg/kg to about 10 mg/kg or about 0.5 mg/kg to about 50 mg/kg. In some embodiments, the dsRNAi agent is administered at a dose of about 10 mg/kg to about 30 mg/kg. In certain embodiments, the dsRNAi agent is administered at a dose selected from 0.5 mg/kg 1 mg/kg, 1.5 mg/kg, 3 mg/kg, 5 mg/kg, 10 mg/kg, and 30 mg/kg. In certain embodiments, the dsRNAi agent is administered about once per week, once per month, once every other two months, or once a quarter (i.e., once every three months) at a dose of about 0.1 mg/kg to about 5.0 mg/kg.

In certain embodiments, the double stranded RNAi agent is administered to the subject once a week. In certain embodiments, the dsRNAi agent is administered to the subject once a month. In certain embodiments, the dsRNAi agent is administered once per quarter (i.e., every three months).

In some embodiment, the dsRNAi agent is administered to the subject subcutaneously.

In various embodiments, the methods of the invention further comprise determining the level of IGF-1 in the subject. In certain embodiments, a decrease in the level of expression or activity of the IGF-1 signaling pathway indicates that the IGF system-associated disease is being treated.

In various embodiments, a surrogate marker of IGF-1 expression is measured. In certain embodiments, a change, preferably a clinically relevant change in the surrogate marker indicating effective treatment of diseases associated with an elevated IGF-level are detected, e.g., decreased serum IGF. In the treatment of acromegaly, a clinically relevant change in one or more signs or symptoms associated with acromegaly as provided below can be used as a surrogate marker for a reduction in IGF-1 expression. In the treatment of cancer, a demonstration of stabilization or reduction of tumor burden using RECIST criteria can be used as a surrogate marker for a reduction of IGF-1 expression or activity.

BRIEF DESCRIPTION OF THE DRAWINGS

FIG. 1 is a schematic showing various aspects of the IGF-1 signaling pathways.

DETAILED DESCRIPTION OF THE INVENTION

The present invention provides iRNA compositions which effect the RNA-induced silencing complex (RISC)-mediated cleavage of RNA transcripts of an Insulin-like Growth Factor Binding Protein, Acid Labile Subunit (IGFALS) or Insulin-like Growth Factor 1 (IGF-1) gene. The gene may be within a cell, e.g., a cell within a subject, such as a human. The use of these iRNAs enables the targeted degradation of mRNAs of the corresponding gene (IGFALS or IGF-1 gene) in mammals.

The iRNAs of the invention have been designed to target a human IGFALS or a human IGF-1 gene, including portions of the gene that are conserved in the IGFALS or IGF-1 othologs of other mammalian species. Without intending to be limited by theory, it is believed that a combination or sub-combination of the foregoing properties and the specific target sites or the specific modifications in these iRNAs confer to the iRNAs of the invention improved efficacy, stability, potency, durability, and safety.

Accordingly, the present invention also provides methods for treating a subject having a disorder that would benefit from inhibiting or reducing the expression of an IGFALS or IGF-1 gene, e.g., an IGF system-associated disease, such as acromegaly or cancer, such as a cancer in which the tumor expresses IGF-1, using iRNA compositions which effect the RNA-induced silencing complex (RISC)-mediated cleavage of RNA transcripts of an IGFALS or an IGF-1 gene.

Very low dosages of the iRNAs of the invention, in particular, can specifically and efficiently mediate RNA interference (RNAi), resulting in significant inhibition of expression of the corresponding target gene (IGFALS or IGF-1gene).

The iRNAs of the invention include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of an IGFALS or IGF-1 gene.

In certain embodiments, the iRNAs of the invention include an RNA strand (the antisense strand) which can include longer lengths, for example up to 66 nucleotides, e.g., 36-66, 26-36, 25-36, 31-60, 22-43, 27-53 nucleotides in length with a region of at least 19 contiguous nucleotides that is substantially complementary to at least a part of an mRNA transcript of an IGFALS or an IGF-1 gene.

In some embodiments, the iRNA agents for use in the methods of the invention include an RNA strand (the antisense strand) which can be up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA transcript of an IGFALS or an IGF-1 gene. In some embodiments, such iRNA agents having longer length antisense strands preferably include a second RNA strand (the sense strand) of 20-60 nucleotides in length wherein the sense and antisense strands form a duplex of 18-30 contiguous nucleotides.

Using in vitro and in vivo assays, the present inventors have demonstrated that iRNAs targeting an IGFALS gene or an or IGF-1 gene can mediate RNAi, resulting in significant inhibition of expression of IGFALS or IGF-1, as well as reducing signaling through the IGF-1 pathway which will decrease one or more of the symptoms associated with an IGF system-associated disease, such as acromegaly or cancer. Thus, methods and compositions including these iRNAs are useful for treating a subject having an IGF system-associated disease, such as acromegaly or cancer. The methods and compositions herein are useful for reducing the level of IGFALS or IGF-1 in a subject, e.g., serum or liver IGF-1 in a subject, especially in a subject with acromegaly or a tumor, such as an IGF-1 expressing tumor.

The following detailed description discloses how to make and use compositions containing iRNAs to inhibit the expression of an IGFALS gene or an IGF gene as well as compositions, uses, and methods for treating subjects having diseases and disorders that would benefit from reduction of the expression of an IGFALS gene or an IGF gene.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise. For example, "sense strand or antisense strand" is understood as "sense strand or antisense strand or sense strand and antisense strand."

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleotides of a 21 nucleotide nucleic acid molecule" means that 18, 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or intergers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range.

As used herein, ranges include both the upper and lower limit.

In the event of a conflict between a sequence and its indicated site on a transcript or other sequence, the nucleotide sequence recited in the specification takes precedence.

Various embodiments of the invention can be combined as determined appropriate by one of skill in the art.

As used herein, "insulin-like growth factor binding protein, acid labile subunit" or "IGFALS" is a serum protein that binds insulin-like growth factors, increasing their half-life and their vascular localization. Production of the encoded protein, predominantly in the liver, which contains twenty leucine-rich repeats, is stimulated by growth hormone. Defects in this gene are a cause of acid-labile subunit deficiency, which manifests itself in delayed and slow puberty. Three transcript variants encoding two different isoforms have been found for this gene. The gene can also be known as ALS or ACLSD. Further information on IGFALS is provided, for example in the NCBI Gene database at www.ncbi.nlm.nih.gov/gene/3483 (which is incorporated herein by reference as of the date of filing this application).

As used herein, "insulin-like growth factor binding protein, acid labile subunit," used interchangeably with the term "IGFALS," refers to the naturally occurring gene that encodes an IGF-1 binding protein. The amino acid and complete coding sequences of the reference sequence of the human IGFALS gene may be found in, for example, GenBank Accession No. GI: 225579150 (RefSeq Accession No. NM_004970.2; SEQ ID NO:1; SEQ ID NO:2), GenBank Accession No. GI:225579151 (RefSeq Accession No. NM_001146006.1; SEQ ID NO: 9 and 10). Mammalian orthologs of the human IGFALS gene may be found in, for example, GI:142388344 (RefSeq Accession No. NM_008340.3, mouse; SEQ ID NO:3 and SEQ ID NO:4); GI:71896591 (RefSeq Accession No. NM_053329.2, rat; SEQ ID NO:5 and SEQ ID NO:6); GenBank Accession Nos. GI:544514850 (RefSeq Accession No. XM_005590898.1, cynomolgus monkey; SEQ ID NO:7 and SEQ ID NO:8).

A number of naturally occurring SNPs are known and can be found, for example, in the SNP database at the NCBI at www.ncbi.nlm.nih.gov/SNP/snp_ref.cgi?locusId=3483 (which is incorporated herein by reference as of the date of filing this application) which lists SNPs in human IGFALS. In preferred embodiments, such naturally occurring variants are included within the scope of the IGFALS gene sequence.

Additional examples of IGFALS mRNA sequences are readily available using publicly available databases, e.g., GenBank, UniProt, and OMIM.

"Insulin-like growth factor 1" or "IGF-1", also known as MGF, encodes a protein similar to insulin in function and structure and is a member of a family of proteins involved in mediating growth and development. The encoded protein is processed from a precursor, bound by a specific receptor, and secreted. Defects in this gene are a cause of insulin-like growth factor I deficiency. Alternative splicing results in multiple transcript variants encoding different isoforms that may undergo similar processing to generate mature protein. Further information on IGF-1 is provided, for example, in the NCBI Gene database at www.ncbi.nlm.nih.gov/gene/3479 (which is incorporated herein by reference as of the date of filing this application).

As used herein, "insulin-like growth factor 1" is used interchangeably with the term "IGF-1" (and optionally any of the other recognized names listed above) refers to the naturally occurring gene that encodes an insulin-like growth factor 1 protein. The amino acid and complete coding sequences of the reference sequence of the human IGF-1 gene, transcript variant 1, mRNA, may be found in, for example, GenBank Accession No. GI: 930588898 (RefSeq Accession No. NM_001111283.2; SEQ ID NO: 11; SEQ ID NO: 12); human IGF-1 gene, transcript variant 4, mRNA, may be found at GenBank Accession No. GI: 930616505 (RefSeq Accession No. NM_000618.4; SEQ ID NO: 13 and SEQ ID NO:14); and human IGF-1, transcript variant 2, mRNA, may be found at GenBank Accession No. GI: 163659900 (RefSeq Accession No. NM_001111284.1; SEQ ID NO: 15 and 16. Mammalian orthologs of the human IGF-1 gene may be found in, for example, GI: 930155588 (RefSeq Accession No. NM_010512.5, mouseIGF-1; SEQ ID NO:17 and SEQ ID NO:18); GI: 126722710 (RefSeq Accession No. NM_001082478.1, rat; SEQ ID NO:19 and SEQ ID NO:20); GenBank Accession Nos. GI: 544472486 (RefSeq Accession No. XM_005572040.1, cynomolgus monkey; SEQ ID NO:21 and SEQ ID NO:22). Multiple sequence variants for each of the species are known.

A number of naturally occurring SNPs are known and can be found, for example, in the SNP database at the NCBI at www.ncbi.nlm.nih.gov/SNP/snp_ref.cgi?locusId=3479 (which is incorporated herein by reference as of the date of filing this application) which lists SNPs in human IGF-1. In preferred embodiments, such naturally occurring variants are included within the scope of the IGF-1 gene sequence.

Additional examples of IGF-1 mRNA sequences are readily available using publicly available databases, e.g., GenBank, UniProt, and OMIM.

As used herein, "target sequence" refers to a contiguous portion of the nucleotide sequence of an mRNA molecule formed during the transcription of an IGFALS gene or an IGF-1gene, including mRNA that is a product of RNA processing of a primary transcription product. The target portion of the sequence will be at least long enough to serve as a substrate for iRNA-directed cleavage at or near that portion of the nucleotide sequence of an mRNA molecule formed during the transcription of an IGFALS gene or an IGF-1gene gene. In one embodiment, the target sequence is within the protein coding region of IGFALS or IGF-1.

The target sequence may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In some embodiments, the target sequence is about 19 to about 30 nucleotides in length. In other embodiments, the target sequence is about 19 to about 25 nucleotides in length. In still other embodiments, the target sequence is about 19 to about 23 nucleotides in length. In some embodiments, the target sequence is about 21 to about 23 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety (see, e.g., Table 2). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA," "RNAi agent," and "iRNA agent," "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of the target gene, e.g., an IGFALS gene or an IGF-1 gene, in a cell, e.g., a cell within a subject, such as a mammalian subject.

In one embodiment, an RNAi agent of the invention includes a single stranded RNAi that interacts with a target RNA sequence, e.g., an IGFALS or IGF-1 target mRNA sequence, to direct the cleavage of the target RNA. Without wishing to be bound by theory it is believed that long double stranded RNA introduced into cells is broken down into double-stranded short interfering RNAs (siRNAs) comprising a sense strand and an antisense strand by a Type III endonuclease known as Dicer (Sharp et al. (2001) *Genes Dev.* 15:485). Dicer, a ribonuclease-III-like enzyme, processes these dsRNA into 19-23 base pair short interfering RNAs with characteristic two base 3' overhangs (Bernstein, et al., (2001) *Nature* 409:363). These siRNAs are then incorporated into an RNA-induced silencing complex (RISC) where one or more helicases unwind the siRNA duplex, enabling the complementary antisense strand to guide target recognition (Nykanen, et al., (2001) *Cell* 107: 309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (ssRNA) (the antisense strand of an siRNA duplex) generated within a cell and which promotes the formation of a RISC complex to effect silencing of the target gene, i.e., an IGFALS or IGF-1 gene. Accordingly, the term "siRNA" is also used herein to refer to an RNAi as described above.

In another embodiment, the RNAi agent may be a single-stranded RNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded RNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In certain embodiments, an "iRNA" for use in the compositions, uses, and methods of the invention is a double stranded RNA and is referred to herein as a "double stranded RNAi agent," "double stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., an IGFALS gene or an IGF-1 gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide or a modified nucleotide. In addition, as used in this specification, an "iRNA" may include ribonucleotides with chemical modifications; an iRNA may include substantial modifications at multiple nucleotides.

As used herein, the term "modified nucleotide" refers to a nucleotide having, independently, a modified sugar moiety, a modified internucleotide linkage, or modified nucleobase, or any combination thereof. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "iRNA" or "RNAi agent" for the purposes of this specification and claims.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, 3, 4, 5, 6, 7, 8, 9, 10, 20, 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In certain embodiments, an iRNA agent of the invention is a dsRNA, each strand of which comprises 19-23 nucleotides, that interacts with a target RNA sequence, e.g., an IGFALS gene or an IGF-1 gene. Without wishing to be bound by theory, long double stranded RNA introduced into cells is broken down into siRNA by a Type III endonuclease known as Dicer (Sharp et al. (2001) Genes Dev. 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) Cell 107:309). Upon binding to the appropriate target mRNA, one or more endonucleases within the RISC cleave the target to induce silencing (Elbashir, et al., (2001) Genes Dev. 15:188).

In some embodiments, an iRNA of the invention is a dsRNA of 24-30 nucleotides, or possibly even longer, e.g., 25-35, 27-53, or 27-49 nucleotides, that interacts with a target RNA sequence, e.g., an IGFALS target mRNA sequence or an IGF-1 target mRNA sequence, to direct the cleavage of the target RNA. Without wishing to be bound by theory, long double stranded RNA introduced into cells is broken down into siRNA by a Type III endonuclease known as Dicer (Sharp et al. (2001) Genes Dev. 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) Cell 107:309). Upon binding to the appropriate target mRNA, one or more endonucleases within the RISC cleave the target to induce silencing (Elbashir, et al., (2001) Genes Dev. 15:188).

As used herein, the term "nucleotide overhang" refers to at least one unpaired nucleotide that protrudes from the duplex structure of a double stranded iRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of either an antisense or sense strand of a dsRNA. In one embodiment of the dsRNA, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In certain embodiments, the antisense strand of a dsRNA has a 1-10 nucleotide, e.g., 0-3, 1-3, 2-4, 2-5, 4-10, 5-10, 1, 2, 3, 4, 5, 6, 7, 8, 9, or 10 nucleotide, overhang at the 3'-end or the 5'-end. In certain embodiments, the overhang on the sense strand or the antisense strand, or both, can include extended lengths longer than 10 nucleotides, e.g., 1-30 nucleotides, 2-30 nucleotides, 10-30 nucleotides, or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the overhang is replaced with a nucleoside thiophosphate.

"Blunt" or "blunt end" means that there are no unpaired nucleotides at that end of the double stranded RNAi agent, i.e., no nucleotide overhang. A "blunt ended" double stranded RNAi agent is double stranded over its entire length, i.e., no nucleotide overhang at either end of the molecule. The RNAi agents of the invention include RNAi agents with no nucleotide overhang at one end (i.e., agents with one overhang and one blunt end) or with no nucleotide overhangs at either end.

The term "antisense strand" or "guide strand" refers to the strand of an iRNA, e.g., a dsRNA, which includes a region that is substantially complementary to a target sequence, e.g., an IGFALS or IGF-1 mRNA. As used herein, the term "region of complementarity" refers to the region on the antisense strand that is substantially complementary to a sequence, for example a target sequence, e.g., an IGFALS or IGF-1 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, 2, or 1 nucleotides of the 5'- or 3'-end of the iRNA. In some embodiments, a double stranded RNAi agent of the invention includes a nucleotide mismatch in the antisense strand. In some embodiments, a double stranded RNAi agent of the invention includes a nucleotide mismatch in the sense strand. In some embodiments, the nucleotide mismatch is, for example, within 5, 4, 3, 2, or 1 nucleotides from the 3'-end of the iRNA. In another embodiment, the nucleotide mismatch is, for example, in the 3'-terminal nucleotide of the iRNA.

The term "sense strand" or "passenger strand" as used herein, refers to the strand of an iRNA that includes a region that is substantially complementary to a region of the antisense strand as that term is defined herein.

As used herein, "substantially all of the nucleotides are modified" are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of a double stranded RNAi agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding an IGFALS gene or an IGF-1 gene). For example, a polynucleotide is complementary to at least a part of an IGFALS or IGF-1 mRNA if the sequence is substantially complementary to a non-interrupted portion of an mRNA encoding an IGFALS or IGF-1 gene.

Accordingly, in some embodiments, the sense strand polynucleotides and the antisense polynucleotides disclosed herein are fully complementary to the target IGFALS or IGF-1sequence.

In one embodiment, the antisense polynucleotides disclosed herein are fully complementary to the target IGFALS sequence. In other embodiments, the antisense polynucleotides disclosed herein are substantially complementary to the target IGFALS sequence and comprise a contiguous nucleotide sequence which is at least about 80% complementary over its entire length to the equivalent region of the nucleotide sequence of any one of SEQ ID NOs:1, 3, 5, 7, or 9, or a fragment of any one of SEQ ID NOs:1, 3, 5, 7, or 9, such as about 85%, about 86%, about 87%, about 88%, about 89%, about 90%, about % 91%, about 92%, about 93%, about 94%, about 95%, about 96%, about 97%, about 98%, or about 99% complementary.

In other embodiments, the antisense polynucleotides disclosed herein are substantially complementary to the target IGFALS sequence and comprise a contiguous nucleotide sequence which is at least about 80% complementary over its entire length to any one of the sense strand nucleotide sequences in any one of Tables 3, 5, 6, 8, 12, or 14, or a fragment of any one of the sense strand nucleotide sequences in any one of Tables 3, 5, 6, 8, 12, or 14, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to an antisense polynucleotide which, in turn, is complementary to a target IGFALS sequence and comprises a contiguous nucleotide sequence which is at least about 80% complementary over its entire length to any one of the sense strand nucleotide sequences in any one of Tables 3, 5, 6, 8, 12, or 14, or a fragment of any one of the sense strand nucleotide sequences in any one of Tables 3, 5, 6, 8, 12, or 14, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, the antisense polynucleotides disclosed herein are fully complementary to the target IGF-1 sequence. In other embodiments, the antisense polynucleotides disclosed herein are substantially complementary to the target IGF-1 sequence and comprise a contiguous nucleotide sequence which is at least about 80% complementary over its entire length to the equivalent region of the nucleotide sequence of any one of SEQ ID NOs:11, 13, 15, 17, 19, or 21, or a fragment of any one of SEQ ID NOs:11, 13, 15, 17, 19, or 21, such as about 85%, about 86%, about 87%, about 88%, about 89%, about 90%, about % 91%, about 92%, about 93%, about 94%, about 95%, about 96%, about 97%, about 98%, or about 99% complementary.

In other embodiments, the antisense polynucleotides disclosed herein are substantially complementary to the target IGF-1 sequence and comprise a contiguous nucleotide sequence which is at least about 80% complementary over its entire length to any one of the sense strand nucleotide sequences in any one of Tables 9, 11, 15, 17, 18, or 20, or a fragment of any one of the sense strand nucleotide sequences in any one of Tables 9, 11, 15, 17, 18, or 20, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to an antisense polynucleotide which, in turn, is complementary to a target IGF-1 sequence and comprises a contiguous nucleotide sequence which is at least about 80% complementary over its entire length to any one of the sense strand nucleotide sequences in any one of Tables 9, 11, 15, 17, 18, or 20, or a fragment of any one of the sense strand nucleotide sequences in any one of Tables 9, 11, 15, 17, 18, or 20, such as about 85%, about 86%, about 87%, about 88%, about 89%, about 90%, about % 91%, about 92%, about 93%, about 94%, about 95%, about 96%, about 97%, about 98%, or about 99% complementary.

In an aspect of the invention, an agent for use in the methods and compositions of the invention is a single-stranded antisense oligonucleotide molecule that inhibits a target mRNA via an antisense inhibition mechanism. The single-stranded antisense oligonucleotide molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense oligonucleotide molecule may be about 14 to about 30 nucleotides in length and have a sequence that is complementary to a target sequence. For example, the single-stranded antisense oligonucleotide molecule may comprise a sequence that is at least 14, 15, 16, 17, 18, 19, 20, or more contiguous nucleotides from any one of the antisense sequences described herein.

The phrase "contacting a cell with an iRNA," such as a dsRNA, as used herein, includes contacting a cell by any possible means. Contacting a cell with an iRNA includes contacting a cell in vitro with the iRNA or contacting a cell in vivo with the iRNA. The contacting may be done directly or indirectly. Thus, for example, the iRNA may be put into physical contact with the cell by the individual performing the method, or alternatively, the iRNA may be put into a situation that will permit or cause it to subsequently come into contact with the cell.

Contacting a cell in vitro may be done, for example, by incubating the cell with the iRNA. Contacting a cell in vivo may be done, for example, by injecting the iRNA into or near the tissue where the cell is located, or by injecting the iRNA into another area, e.g., the bloodstream or the subcutaneous space, such that the agent will subsequently reach the tissue where the cell to be contacted is located. For example, the iRNA may contain or be coupled to a ligand, e.g., GalNAc3, that directs the iRNA to a site of interest, e.g., the liver. Combinations of in vitro and in vivo methods of contacting are also possible. For example, a cell may also be contacted in vitro with an iRNA and subsequently transplanted into a subject.

In certain embodiments, contacting a cell with an iRNA includes "introducing" or "delivering the iRNA into the cell" by facilitating or effecting uptake or absorption into the cell. Absorption or uptake of an iRNA can occur through unaided diffusion or active cellular processes, or by auxiliary agents or devices. Introducing an iRNA into a cell may be in vitro or in vivo. For example, for in vivo introduction, iRNA can be injected into a tissue site or administered systemically. In vivo delivery can also be done by a beta-glucan delivery system, such as those described in U.S. Pat. Nos. 5,032,401 and 5,607,677, and US Publication No. 2005/0281781, the entire contents of which are hereby incorporated herein by reference. In vitro introduction into a cell includes methods known in the art such as electroporation and lipofection. Further approaches are described herein below or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a camel, a llama, a horse, a goat, a rabbit, a sheep, a hamster, a guinea pig, a cat, a dog, a rat, a mouse, a horse, and a whale), or a bird (e.g., a duck or a goose) that expresses the target gene, either endogenously or heterologously. It is understood that the sequence of the PHD gene must be sufficiently complementary to the antisense strand of the iRNA agent for the agent to be used in the indicated species. In certain embodiments, the subject is a human, such as a human being treated or assessed for a disease, disorder or condition that would benefit from reduction in an IGFALS gene or an IGF-1 gene expression or replication; a human at risk for a disease, disorder or condition that would benefit from reduction in IGFALS or IGF-1 gene expression; a human having a disease, disorder or condition that would benefit from reduction in IGFALS or IGF-1 gene expression; or human being treated for a disease, disorder or condition that would benefit from reduction in IGFALS or IGF-1 gene expression, as described herein. In some embodiments, the subject is a female human. In other embodiments, the subject is a male human.

As used herein, the terms "treating" or "treatment" refer to a beneficial or desired result including, but not limited to, alleviation or amelioration of one or more symptoms associated with IGFALS or IGF-1 gene expression or IGFALS or IGF-1 protein production, e.g., acromegaly, cancer. "Treatment" can also mean prolonging survival as compared to expected survival in the absence of treatment.

The term "lower" or "reduce" in the context of the level of IGFALS or IGF-1 gene expression or IGFALS or IGF-1 protein production in a subject, or a disease marker or symptom refers to a statistically significant decrease in such level. The decrease can be, for example, at least 30%, 35%, 40%, 45%, 50%, 55%, 60%, 65%, 70%, 75%, 80%, 85%, 90%, or 95%, or below the level of detection for the detection method. In certain embodiments, the decrease is down to a level accepted as within the range of normal for an individual without such disorder which can also be referred to as a normalization of a level. For example, lowering cholesterol to 180 mg/dl or lower would be considered to be within the range of normal for a subject. A subject having a cholesterol level of 230 mg/dl with a cholesterol level decreased to 210 mg/dl would have a cholesterol level that was decreased by 40% (230-210/230-180=20/50=40% reduction). In certain embodiments, the reduction is the normalization of the level of a sign or symptom of a disease, a reduction in the difference between the subject level of a sign of the disease and the normal level of the sign for the disease (e.g., the upper level of normal when the level must be reduced to reach a normal level, and the lower level of normal when the level must be increased to reach a normal level). In certain embodiments, the methods include a clinically relevant inhibition of expression of IGFALS or IGF-1, e.g. as demonstrated by a clinically relevant outcome after treatment of a subject with an agent to reduce the expression of IGFALS or IGF-1.

As used herein, "prevention" or "preventing," when used in reference to a disease, disorder or condition thereof, that would benefit from a reduction in expression of an IGFALS gene or an IGF-1 gene or production of an IGFALS or an IGF-1 protein, refers to a reduction in the likelihood that a subject will develop a symptom associated with such a disease, disorder, or condition, e.g., a symptom of IGFALS or IGF-1 gene expression, such as the presence of elevated levels of proteins in the IGF signaling pathway, e.g., acromegaly or cancer. The failure to develop a disease, disorder or condition, or the reduction in the development of a symptom or comorbidity associated with such a disease, disorder or condition (e.g., by at least about 10% on a clinically accepted scale for that disease or disorder), or the exhibition of delayed symptoms or disease progression (e.g., delayed cancer progression as determined using RECIST criteria) by days, weeks, months or years is considered effective prevention. Prevention may require the administration of more than one dose.

As used herein, the term "IGF system-associated disease," used interchangeable with the terms "insulin-like growth factor binding protein, acid labile subunit-associated disease," "IGFALS-associated disease," "IGF-associated disease," or "IGF-1-associated disease" is a disease or disorder that is caused by, or associated with IGFALS or IGF gene expression or IGFALS or IGF protein production. The term "IGF system-associated disease" includes a disease, disorder or condition that would benefit from a decrease in IGFALS or IGF-1 gene expression, replication, or protein activity. Non-limiting examples of IGF system-associated diseases include, for example, acromegaly, gigantism, and cancer, especially metastatic cancer.

In certain embodiments, an IGF system-associated disease-associated disease is acromegaly.

"Therapeutically effective amount," as used herein, is intended to include the amount of an iRNA that, when administered to a patient for treating a subject having acromealgy, cancer, or IGF system-associated disease, is sufficient to effect treatment of the disease (e.g., by diminishing, ameliorating or maintaining the existing disease or one or more symptoms of disease or its related comorbidities). The "therapeutically effective amount" may vary depending on the iRNA, how it is administered, the disease and its severity and the history, age, weight, family history, genetic makeup, stage of pathological processes mediated by IGFALS or IGF-1 gene expression, the types of preceding or concomitant treatments, if any, and other individual characteristics of the patient to be treated. Treatment may require the administration of more than one dose.

"Prophylactically effective amount," as used herein, is intended to include the amount of an iRNA that, when administered to a subject who does not yet experience or display symptoms of acromealgy, cancer, or other IGF system-associated disease-associated diseases, but who may be predisposed to an IGF system-associated disease-associated disease, is sufficient to prevent or delay the development or progression of the disease or one or more symptoms of the disease for a clinically significant period of time. The "prophylactically effective amount" may vary depending on the iRNA, how it is administered, the degree of risk of disease, and the history, age, weight, family history, genetic makeup, the types of preceding or concomitant treatments, if any, and other individual characteristics of the patient to be treated.

A "therapeutically-effective amount" or "prophylacticaly effective amount" also includes an amount of an iRNA that produces some desired local or systemic effect at a reasonable benefit/risk ratio applicable to any treatment. iRNAs employed in the methods of the present invention may be administered in a sufficient amount to produce a reasonable benefit/risk ratio applicable to such treatment.

The phrase "pharmaceutically acceptable" is employed herein to refer to those compounds, materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition, or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; and (22) other non-toxic compatible substances employed in pharmaceutical formulations.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs, or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). A "sample derived from a subject" can refer to blood drawn from the subject, or plasma derived therefrom. In certain embodiments when detecting a level of IGF-1, a "sample" preferably refers to a tissue or body fluid from a subject in which IGF-1 is detectable prior to administration of an agent of the invention, e.g., a liver biopsy from a subject with a acromegaly, a tumor. In certain subjects, e.g., healthy subjects, the level of IGF-1 may not be detectable in a number of body fluids, cell types, and tissues.

I. iRNAs of the Invention

The present invention provides iRNAs which inhibit the expression of an IGFALS gene or an IGF-1 gene. In preferred embodiments, the iRNA includes double stranded ribonucleic acid (dsRNA) molecules for inhibiting the expression of an IGFALS gene or an IGF-1 gene in a cell, such as a cell within a subject, e.g., a mammal, such as a human having an IGF system-associated disease-associated disease, e.g., acromeagly. The dsRNAi agent includes an antisense strand having a region of complementarity which is complementary to at least a part of an mRNA formed in the expression of an IGFALS gene or an IGF-1 gene. The region of complementarity is about 30 nucleotides or less in length (e.g., about 30, 29, 28, 27, 26, 25, 24, 23, 22, 21, 20, 19, or 18 nucleotides or less in length). Upon contact with a cell expressing the IGFALS gene or the IGF-1 gene, the iRNA inhibits the expression of the IGFALS gene or the IGF-1 gene (e.g., a human, a primate, a non-primate, or a bird IGFALS gene or IGF-1 gene) by at least 20%, preferably at least 30%, as assayed by, for example, a PCR or branched DNA (bDNA)-based method, or by a protein-based method, such as by immunofluorescence analysis, using, for example, western blotting or flowcytometric techniques. In preferred embodiments, inhibition of expression is determined by the qPCR method provided in the examples. For in vitro assessment of activity, percent inhibition is determined using the methods provided in Example 2 at a single dose at a 10 nM duplex final concentration. For in vivo studies, the level after treatment can be compared to, for example, an appropriate historical control or a pooled population sample control to determine the level of reduction, e.g., when a baseline value is no available for the subject.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an IGFALS gene or IGF-1 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is about 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

Similarly, the region of complementarity to the target sequence is about 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

In some embodiments, the dsRNA is about 15 to 23 nucleotides in length, or about 25 to 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to about 36 base pairs, e.g., 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target IGFALS or IGF-1 gene expression is not generated in the target cell by cleavage of a larger dsRNA.

A dsRNA as described herein can further include one or more single-stranded nucleotide overhangs e.g., 1-4, 2-4, 1-3, 2-3, 1, 2, 3, or 4 nucleotides. dsRNAs having at least one nucleotide overhang can have superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of an antisense or sense strand of a dsRNA.

A dsRNA can be synthesized by standard methods known in the art as further discussed below, e.g., by use of an automated DNA synthesizer, such as are commercially available from, for example, Biosearch, Applied Biosystems, Inc.

Double stranded RNAi compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Similarly, single-stranded oligonucleotides of the invention can be prepared using solution-phase or solid-phase organic synthesis or both.

In an aspect, a dsRNA of the invention for inhibiting the expression of an IGFALS gene includes at least two nucleotide sequences, a sense sequence and an anti-sense sequence. The sense strand is selected from the group of sequences provided in any one of Tables 3, 5, 6, 8, 12, and 14, and the corresponding antisense strand of the sense strand is selected from the group of sequences in any one of Tables 3, 5, 6, 8, 12, and 14. In this aspect, one of the two sequences is complementary to the other of the two sequences, with one of the sequences being substantially complementary to a sequence of an mRNA generated in the expression of an IGFALS gene. As such, in this aspect, a dsRNA will include two oligonucleotides, where one oligonucleotide is described as the sense strand in any one of Table 3, 5, 6, 8, 12, and 14, and the second oligonucleotide is described as the corresponding antisense strand of the sense strand in any one of Table 3, 5, 6, 8, 12, and 14. In certain embodiments, the substantially complementary sequences of the dsRNA are contained on separate oligonucleotides. In other embodiments, the substantially complementary sequences of the dsRNA are contained on a single oligonucleotide.

In an aspect, a dsRNA of the invention for inhibiting the expression of an IGF-1 gene includes at least two nucleotide sequences, a sense sequence and an anti-sense sequence. The sense strand is selected from the group of sequences provided in any one of Tables 9, 11, 15, 17, 18, and 20, and the corresponding antisense strand of the sense strand is selected from the group of sequences in any one of Tables 9, 11, 15, 17, 18, and 20. In this aspect, one of the two sequences is complementary to the other of the two sequences, with one of the sequences being substantially complementary to a sequence of an mRNA generated in the expression of an IGF-1 gene. As such, in this aspect, a dsRNA will include two oligonucleotides, where one oligonucleotide is described as the sense strand in any one of Table 9, 11, 15, 17, 18, and 20, and the second oligonucleotide is described as the corresponding antisense strand of the sense strand in any one of Table 9, 11, 15, 17, 18, and 20. In certain embodiments, the substantially complementary sequences of the dsRNA are contained on separate oligonucleotides. In other embodiments, the substantially complementary sequences of the dsRNA are contained on a single oligonucleotide.

It will be understood that, although the sequences in Tables 3, 6, 9, 12, 15, and 18 are not described as modified or conjugated sequences, the RNA of the iRNA of the invention e.g., a dsRNA of the invention, may comprise any one of the sequences set forth in any one of Tables 3, 6, 9, 12, 15, and 18, or the sequences of any one of Tables 5, 8, 11, 14, 17, and 20 that are modified, or the sequences of any one of Tables 5, 8, 11, 14, 17, and 20 that are conjugated to a ligand. In other words, the invention encompasses dsRNAs of any one of Tables 3, 5, 6, 8, 9, 11, 12, 14, 15, 17, 18, and 20 which are un-modified, un-conjugated, modified, or conjugated, as described herein.

The skilled person is well aware that dsRNAs having a duplex structure of between about 20 and 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of Tables 3, 5, 6, 8, 9, 11, 12, 14, 15, 17, 18, and 20, dsRNAs described herein can include at least one strand of a length of minimally 21 nucleotides. It can be reasonably expected that shorter duplexes having one of the sequences of Tables 3, 5, 6, 8, 9, 11, 12, 14, 15, 17, 18, and 20 minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences of Tables 3, 5, 6, 8, 9, 11, 12, 14, 15, 17, 18, and 20, and differing in their ability to inhibit the expression of an IGFALS gene or an IGF-1 gene by not more than about 5, 10, 15, 20, 25, or 30% inhibition from a dsRNA comprising the full sequence, are contemplated to be within the scope of the present invention.

In addition, the RNAs provided in Tables 3, 5, 6, 8, 9, 11, 12, 14, 15, 17, 18, and 20 identify a site(s) in an IGFALS transcript or IGF-1 transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 15 contiguous nucleotides from one of the sequences provided in Tables 3, 5, 6, 8, 9, 11, 12, 14, 15, 17, 18, and 20 coupled to additional nucleotide sequences taken from the region contiguous to the selected sequence in an IGFALS gene or an IGF-1 gene.

While a target sequence is generally about 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art or provided herein) to identify those sequences that perform optimally can identify those RNA sequences that, when targeted with an iRNA agent, mediate the best inhibition of target gene expression. Thus, while the sequences identified, for example, in Tables 3 and 5 represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified, e.g., in Tables 3, 5, 6, 8, 9, 11, 12, 14, 15, 17, 18, and 20, further optimization could be achieved by systematically either adding or removing nucleotides to generate longer or shorter sequences and testing those sequences generated by walking a window of the longer or shorter size up or down the target RNA from that point. Again, coupling this approach to generating new candidate targets with testing for effectiveness of iRNAs based on those target sequences in an inhibition assay as known in the art or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes) as an expression inhibitor.

An iRNA as described herein can contain one or more mismatches to the target sequence. In one embodiment, an iRNA as described herein contains no more than 3 mismatches. If the antisense strand of the iRNA contains mismatches to a target sequence, it is preferable that the area of mismatch is not located in the center of the region of complementarity. If the antisense strand of the iRNA contains mismatches to the target sequence, it is preferable that the mismatch be restricted to be within the last 5 nucleotides from either the 5'- or 3'-end of the region of complementarity. For example, for a 23 nucleotide iRNA agent the strand which is complementary to a region of an IGFALS gene or an IGF-1 gene, generally does not contain any mismatch within the central 13 nucleotides. The methods described herein or methods known in the art can be used to determine whether an iRNA containing a mismatch to a target sequence is effective in inhibiting the expression of an IGFALS gene or IGF-1 gene. Consideration of the efficacy of iRNAs with mismatches in inhibiting expression of an IGFALS gene or an IGF-1 gene is important, especially if the particular region of complementarity in an IGFALS gene or an IGF-1 gene is known to have polymorphic sequence variation within the population.

II. Modified iRNAs of the Invention

In certain embodiments, the RNA of the iRNA of the invention e.g., a dsRNA, is unmodified, and does not comprise, e.g., chemical modifications or conjugations known in the art and described herein. In other embodiments, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA or substantially all of the nucleotides of an iRNA are modified, i.e., not more than 5, 4, 3, 2, or 1 unmodified nucleotides are present in a strand of the iRNA.

The nucleic acids featured in the invention can be synthesized or modified by methods well established in the art, such as those described in "Current protocols in nucleic acid chemistry," Beaucage, S. L. et al. (Edrs.), John Wiley &

Sons, Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative US patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

Representative US patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, the entire contents of each of which are hereby incorporated herein by reference.

Suitable RNA mimetics are contemplated for use in iRNAs provided herein, in which both the sugar and the internucleoside linkage, i.e., the backbone, of the nucleotide units are replaced with novel groups. The base units are maintained for hybridization with an appropriate nucleic acid target compound. One such oligomeric compound in which an RNA mimetic that has been shown to have excellent hybridization properties is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative US patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science,* 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$—[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$—[wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position:OH; F; O-, S-, or N-alkyl; O, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include O[$(CH_2)_nO]_mCH_3$, O$(CH_2)_n$.$_nOCH_3$, O$(CH_2)_nNH_2$, O$(CH_2)_nCH_3$, O$(CH_2)_nONH_2$, and O$(CH_2)_nON$ [$(CH_2)_nCH_3)$]$_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta,* 1995, 78:486-504) i.e., an alkoxy-alkoxy group. Another exemplary modification is 2'-dimethylaminooxyethoxy, i.e., a O$(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O-CH$_2$-O-CH$_2$—N(CH$_2$)$_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-OCH$_3$), 2'-aminopropoxy (2'-OCH$_2$CH$_2$CH$_2$NH$_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative US patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C), and uracil (U). Modified nucleobases include other synthetic and natural nucleobases such as deoxy-thymine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. I., ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative US patents that teach the preparation of certain of the above noted modified nucleobases as well as other modified nucleobases include, but are not limited to, the above noted U.S. Pat. Nos. 3,687,808, 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12): 3185-3193).

In some embodiments, the iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

The RNA of an iRNA can also be modified to include one or more bicyclic sugar moieties. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH$_2$-O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-(CH$_2$)—O-2' (LNA); 4'-(CH$_2$)—S-2'; 4'-(CH$_2$)$_2$—O-2' (ENA); 4'-CH(CH$_3$)—O-2' (also referred to as "constrained ethyl" or "cEt") and 4'-CH(CH$_2$OCH$_3$)—O-2' (and analogs thereof; see, e.g., U.S. Pat. No. 7,399,845); 4'-C(CH$_3$)(CH$_3$)—O-2' (and analogs thereof; see e.g., U.S. Pat. No. 8,278,283); 4'-CH$_2$—N(OCH$_3$)-2' (and analogs thereof; see e.g., U.S. Pat. No. 8,278,425); 4'-CH$_2$—O—N(CH$_3$)-2' (see, e.g., US Patent Publication No. 2004/0171570); 4'-CH$_2$—N(R)—O-2', wherein R is H, C1-C12 alkyl, or a protecting group (see, e.g., U.S. Pat. No. 7,427,672); 4'-CH$_2$—C(H)(CH$_3$)-2' (see, e.g., Chattopadhyaya et al., *J. Org. Chem.*, 2009, 74, 118-134); and 4'-CH$_2$—C(=CH$_2$)-2' (and analogs thereof; see, e.g., U.S. Pat. No. 8,278,426). The entire contents of each of the foregoing are hereby incorporated herein by reference.

Additional representative US patents and US Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH(CH$_3$)—O-2' bridge. In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and -C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US Patent Publication No. 2013/0190383; and PCT publication WO 2013/036868, the entire contents of each of which are hereby incorporated herein by reference.

Representative US publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-0-deoxythymidine (ether), N-(aminocaproyl)-4-hydroxyprolinol (Hyp-C6-amino), 2-docosanoyl-uridine-3"-phosphate, inverted base dT (idT) and others. Disclosure of this modification can be found in PCT Publication No. WO 2011/005861.

Other modifications of the nucleotides of an iRNA of the invention include a 5' phosphate or 5' phosphate mimic, e.g., a 5'-terminal phosphate or phosphate mimic on the antisense strand of an iRNA. Suitable phosphate mimics are disclosed in, for example US Patent Publication No. 2012/0157511, the entire contents of which are incorporated herein by reference.

A. Modified iRNAs Comprising Motifs of the Invention

In certain aspects of the invention, the double stranded RNAi agents of the invention include agents with chemical modifications as disclosed, for example, in WO2013/075035, the entire contents of each of which are incorporated herein by reference. WO2013/075035 provides motifs of three identical modifications on three consecutive nucleotides into a sense strand or antisense strand of a dsRNAi agent, particularly at or near the cleavage site. In some embodiments, the sense strand and antisense strand of the dsRNAi agent may otherwise be completely modified. The introduction of these motifs interrupts the modification pattern, if present, of the sense or antisense strand. The dsRNAi agent may be optionally conjugated with a GalNAc derivative ligand, for instance on the sense strand.

More specifically, when the sense strand and antisense strand of the double stranded RNAi agent are completely modified to have one or more motifs of three identical modifications on three consecutive nucleotides at or near the cleavage site of at least one strand of a dsRNAi agent, the gene silencing activity of the dsRNAi agent was observed.

Accordingly, the invention provides double stranded RNAi agents capable of inhibiting the expression of a target gene (i.e., IGFALS or IGF-1 gene) in vivo. The RNAi agent comprises a sense strand and an antisense strand. Each strand of the RNAi agent may be, independently, 12-30 nucleotides in length. For example, each strand may independently be 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as "dsRNAi agent." The duplex region of a dsRNAi agent may be 12-30 nucleotide pairs in length. For example, the duplex region can be 14-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, 27, 28, 29, or 30 nucleotides in length.

In certain embodiments, the sense and antisense strands may be even longer. For example, in certain embodiments, the sense strand and the antisense strand are independently 25-35 nucleotides in length. In certain embodiments, each the sense and the antisense strand are independently 27-53 nucleotides in length, e.g., 27-49, 31-49, 33-49, 35-49, 37-49, and 39-49 nucleotides in length. In certain embodiments, the dsRNAi agent may contain one or more overhang regions or capping groups at the 3'-end, 5'-end, or both ends of one or both strands. The overhang can be, independently, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In certain embodiments, at least one strand of the dsRNAi agent comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the dsRNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the dsRNAi agent comprise an overhang of at least 1 nucleotide.

In certain embodiments, the overhang regions can include extended overhang regions as provided above. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In certain embodiments, the nucleotides in the overhang region of the dsRNAi agent can each independently be a modified or unmodified nucleotide including, but no limited to 2'-sugar modified, such as, 2'-F, 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand, or both strands of the dsRNAi agent may be phosphorylated. In some embodiments, the overhang region(s) contains two nucleotides having a phosphorothioate between the two nucleotides, where the two nucleotides can be the same or different. In some embodiments, the overhang is present at the 3'-end of the sense strand, antisense strand, or both strands. In some embodiments, this 3'-overhang is present in the antisense strand. In some embodiments, this 3'-overhang is present in the sense strand.

The dsRNAi agent may contain only a single overhang, which can strengthen the interference activity of the RNAi, without affecting its overall stability. For example, the single-stranded overhang may be located at the 3'-end of the sense strand or, alternatively, at the 3'-end of the antisense strand. The RNAi may also have a blunt end, located at the 5'-end of the antisense strand (or the 3'-end of the sense strand) or vice versa. Generally, the antisense strand of the dsRNAi agent has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In certain embodiments, the dsRNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In other embodiments, the dsRNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet other embodiments, the dsRNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In certain embodiments, the dsRNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. Preferably, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In certain embodiments, every nucleotide in the sense strand and the antisense strand of the dsRNAi agent, including the nucleotides that are part of the motifs are modified nucleotides. In certain embodiments each residue is independently modified with a 2'-O-methyl or 3'-fluoro, e.g., in an alternating motif. Optionally, the dsRNAi agent further comprises a ligand (preferably GalNAc$_3$).

In certain embodiments, the dsRNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In certain embodiments, the dsRNAi agent comprises sense and antisense strands, wherein the dsRNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region region which is at least 25 nucleotides in length, and the second strand is sufficiently complemenatary to a target mRNA along at least 19 nucleotide of the second strand length to reduce target gene expression when the RNAi agent is introduced into a mammalian cell, and wherein Dicer cleavage of the dsRNAi agent preferentially results in an siRNA comprising the 3'-end of the second strand, thereby reducing expression of the target gene in the mammal. Optionally, the dsRNAi agent further comprises a ligand.

In certain embodiments, the sense strand of the dsRNAi agent contains at least one motif of three identical modifications on three consecutive nucleotides, where one of the motifs occurs at the cleavage site in the sense strand.

In certain embodiments, the antisense strand of the dsRNAi agent can also contain at least one motif of three identical modifications on three consecutive nucleotides, where one of the motifs occurs at or near the cleavage site in the antisense strand.

For a dsRNAi agent having a duplex region of 17-23 nucleotides in length, the cleavage site of the antisense strand is typically around the 10, 11, and 12 positions from the 5'-end. Thus the motifs of three identical modifications may occur at the 9, 10, 11 positions; the 10, 11, 12 positions; the 11, 12, 13 positions; the 12, 13, 14 positions; or the 13, 14, 15 positions of the antisense strand, the count starting from the first nucleotide from the 5'-end of the antisense strand, or, the count starting from the first paired nucleotide within the duplex region from the 5'-end of the antisense strand. The cleavage site in the antisense strand may also change according to the length of the duplex region of the dsRNAi agent from the 5'-end.

The sense strand of the dsRNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In some embodiments, the sense strand of the dsRNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistries of the motifs are distinct from each other, and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the dsRNAi agent may contain more than one motif of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In some embodiments, the wing modification on the sense strand or antisense strand of the dsRNAi agent typically does not include the first one or two terminal nucleotides at the 3'-end, 5'-end, or both ends of the strand.

In other embodiments, the wing modification on the sense strand or antisense strand of the dsRNAi agent typically does not include the first one or two paired nucleotides within the duplex region at the 3'-end, 5'-end, or both ends of the strand.

When the sense strand and the antisense strand of the dsRNAi agent each contain at least one wing modification, the wing modifications may fall on the same end of the duplex region, and have an overlap of one, two, or three nucleotides.

When the sense strand and the antisense strand of the dsRNAi agent each contain at least two wing modifications, the sense strand and the antisense strand can be so aligned that two modifications each from one strand fall on one end of the duplex region, having an overlap of one, two, or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In some embodiments, every nucleotide in the sense strand and antisense strand of the dsRNAi agent, including the nucleotides that are part of the motifs, may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2'-hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3'- or 5'-terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a dsRNAi agent or may only occur in a single strand region of a dsRNAi agent. For example, a phosphorothioate modification at a non-linking O position may only occur at one or both ends, may only occur in a terminal region, e.g., at a position on a terminal nucleotide, or in the last 2, 3, 4, 5, or 10 nucleotides of a strand, or may occur in double strand and single strand regions, particularly at the ends. The 5'-end or ends can be phosphorylated.

It may be possible, e.g., to enhance stability, to include particular bases in overhangs, or to include modified nucleotides or nucleotide surrogates, in single strand overhangs, e.g., in a 5'- or 3'-overhang, or in both. For example, it can be desirable to include purine nucleotides in overhangs. In some embodiments all or some of the bases in a 3'- or 5'-overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In certain embodiments, the $N_a$ or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AAB-BAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In some embodiments, the dsRNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5' to 3' of the strand and the alternating motif in the antisense strand may start with "BABABA" from 5' to 3' of the strand within the duplex region. As another example, the alternating motif in the sense strand may start with "AABBAABB" from 5' to 3' of the strand and the alternating motif in the antisense strand may start with "BBAABBAA" from 5' to 3' of the strand within the duplex region, so that there is a complete or partial shift of the modification patterns between the sense strand and the antisense strand.

In some embodiments, the dsRNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand or antisense strand interrupts the initial modification pattern present in the sense strand or antisense strand. This interruption of the modification pattern of the sense or antisense strand by introducing one or more motifs of three identical modifications on three consecutive nucleotides to the sense or antisense strand may enhance the gene silencing activity against the target gene.

In some embodiments, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ or $N_b$ may be present or absent when there is a wing modification present.

The iRNA may further comprise at least one phosphorothioate or methylphosphonate internucleotide linkage. The phosphorothioate or methylphosphonate internucleotide linkage modification may occur on any nucleotide of the sense strand, antisense strand, or both strands in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8phosphorothioate internucleotide linkages. In some embodiments, the antisense strand comprises two phosphorothioate internucleotide linkages at the 5'-end and two phosphorothioate internucleotide linkages at the 3'-end, and the sense strand comprises at least two phosphorothioate internucleotide linkages at either the 5'-end or the 3'-end.

In some embodiments, the dsRNAi agent comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, or the 5'end of the antisense strand.

In some embodiments, the 2-nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the dsRNAi agent may additionally have two phosphorothioate internucleotide linkages between the terminal three nucleotides at both the 5'-end of the sense strand and at the 5'-end of the antisense strand.

In one embodiment, the dsRNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In certain embodiments, the dsRNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In certain embodiments, the nucleotide at the 1 position within the duplex region from the 5'-end in the antisense strand is selected from A, dA, dU, U, and dT. Alternatively, at least one of the first 1, 2, or 3 base pair within the duplex region from the 5'-end of the antisense strand is an AU base pair. For example, the first base pair within the duplex region from the 5'-end of the antisense strand is an AU base pair.

In other embodiments, the nucleotide at the 3'-end of the sense strand is deoxy-thymine (dT) or the nucleotide at the 3'-end of the antisense strand is deoxy-thymine (dT). For example, there is a short sequence of deoxy-thymine nucleotides, for example, two dT nucleotides on the 3'-end of the sense, antisense strand, or both strands.

In certain embodiments, the sense strand sequence may be represented by formula (I):

wherein:
i and j are each independently 0 or 1;
p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein Nb and Y do not have the same modification; and

XXX, YYY, and ZZZ each independently represent one motif of three identical modifications on three consecutive nucleotides. Preferably YYY is all 2'-F modified nucleotides.

In some embodiments, the $N_a$ or $N_b$ comprises modifications of alternating pattern.

In some embodiments, the YYY motif occurs at or near the cleavage site of the sense strand. For example, when the dsRNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11, 12; or 11, 12, 13) of the sense strand, the count starting from the first nucleotide, from the 5'-end; or optionally, the count starting at the first paired nucleotide within the duplex region, from the 5'-end.

In one embodiment, i is 1 and j is 0, or i is 0 and j is 1, or both i and j are 1. The sense strand can therefore be represented by the following formulas:

When the sense strand is represented by formula (Ib), $N_b$ represents an oligonucleotide sequence comprising 0-10, 0-7, 0-5, 0-4, 0-2, or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2, or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2, or 0 modified nucleotides. Preferably, $N_b$ is 0, 1, 2, 3, 4, 5, or 6 Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

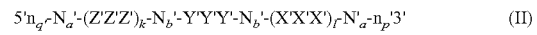

wherein:
k and l are each independently 0 or 1;
p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_n'$ independently represent an overhang nucleotide;

wherein $N_b'$ and Y' do not have the same modification; and

X'X'X', Y'Y'Y', and Z'Z'Z' each independently represent one motif of three identical modifications on three consecutive nucleotides.

In some embodiments, the $N_a'$ or $N_b'$ comprises modifications of alternating pattern.

The Y'Y'Y' motif occurs at or near the cleavage site of the antisense strand. For example, when the dsRNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the first nucleotide, from the 5'-end; or optionally, the count starting at the first paired nucleotide within the duplex region, from the 5'-end. Preferably, the Y'Y'Y' motif occurs at positions 11, 12, 13.

In certain embodiments, Y'Y'Y' motif is all 2'-OMe modified nucleotides.

In certain embodiments, k is 1 and l is 0, or k is 0 and l is 1, or both k and l are 1.

The antisense strand can therefore be represented by the following formulas:

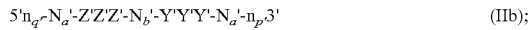  (IIb);

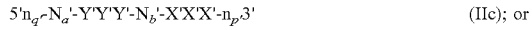  (IIc); or

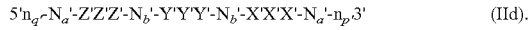  (IId).

When the antisense strand is represented by formula (IIb), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IIC), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5, or 6.

In other embodiments, k is 0 and l is 0 and the antisense strand may be represented by the formula:

  (Ia).

When the antisense strand is represented as formula (IIa), each $N_a'$ independently represents an oligonucleotide sequence comprising 2-20, 2-15, or 2-10 modified nucleotides. Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y', and Z', in particular, may represent a 2'-O-methyl modification or a 2'-fluoro modification.

In some embodiments, the sense strand of the dsRNAi agent may contain YYY motif occurring at 9, 10, and 11 positions of the strand when the duplex region is 21 nt, the count starting from the first nucleotide from the 5'-end, or optionally, the count starting at the first paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may contain Y'Y'Y' motif occurring at positions 11, 12, 13 of the strand, the count starting from the first nucleotide from the 5'-end, or optionally, the count starting at the first paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the dsRNAi agents for use in the methods of the invention may comprise a sense strand and an antisense strand, each strand having 14 to 30 nucleotides, the iRNA duplex represented by formula (III):

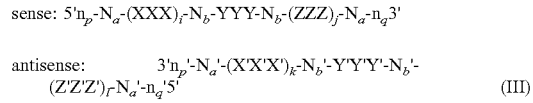  (III)

wherein:

j, k, and l are each independently 0 or 1;

p, p', q, and q' are each independently 0-6;

each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides;

wherein each $n_p'$, $n_p$, $n_q'$, and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming an iRNA duplex include the formulas below:

  (IIIa)

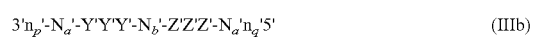

  (IIIb)

3'n$_p$'-N$_a$'-X'X'X'-N$_b$'-Y'Y'Y'-N$_a$'-n$_q$'5'   (IIIc)

5'n$_p$-N$_a$-XXX-N$_b$-YYY-N$_b$-ZZZ-N$_a$-n$_q$3'

3'n$_p$'-N$_a$'-X'X'X'-N$_b$'-Y'Y'Y'-N$_b$'-Z'Z'Z'-N$_a$'-n$_q$'5'   (IIId)

When the dsRNAi agent is represented by formula (IIIa), each N$_a$ independently represents an oligonucleotide sequence comprising 2-20, 2-15, or 2-10 modified nucleotides.

When the dsRNAi agent is represented by formula (IIIb), each N$_b$ independently represents an oligonucleotide sequence comprising 1-10, 1-7, 1-5, or 1-4 modified nucleotides. Each N$_a$ independently represents an oligonucleotide sequence comprising 2-20, 2-15, or 2-10 modified nucleotides.

When the dsRNAi agent is represented as formula (IIIc), each N$_b$, N$_b$' independently represents an oligonucleotide sequence comprising 0-10, 0-7, 0-10, 0-7, 0-5, 0-4, 0-2, or 0 modified nucleotides. Each N$_a$ independently represents an oligonucleotide sequence comprising 2-20, 2-15, or 2-10 modified nucleotides.

When the dsRNAi agent is represented as formula (IIId), each N$_b$, N$_b$' independently represents an oligonucleotide sequence comprising 0-10, 0-7, 0-10, 0-7, 0-5, 0-4, 0-2, or 0 modified nucleotides. Each N$_a$, N$_a$' independently represents an oligonucleotide sequence comprising 2-20, 2-15, or 2-10 modified nucleotides. Each of N$_a$, N$_a$', N$_b$, and N$_b$ independently comprises modifications of alternating pattern.

Each of X, Y, and Z in formulas (III), (IIIa), (IIIb), (IIIc), and (IIId) may be the same or different from each other.

When the dsRNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the dsRNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the dsRNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In certain embodiments, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In certain embodiments, when the dsRNAi agent is represented by formula (IIId), the N$_a$ modifications are 2'-O-methyl or 2'-fluoro modifications. In other embodiments, when the RNAi agent is represented by formula (IIId), the N$_a$ modifications are 2'-O-methyl or 2'-fluoro modifications and n$_p$'>0 and at least one n$_p$' is linked to a neighboring nucleotide a via phosphorothioate linkage. In yet other embodiments, when the RNAi agent is represented by formula (IIId), the N$_a$ modifications are 2'-O-methyl or 2'-fluoro modifications, n$_p$'>0 and at least one n$_p$' is linked to a neighboring nucleotide via phosphorothioate linkage, and the sense strand is conjugated to one or more GalNAc derivatives attached through a monovalent, a bivalent or a trivalent branched linker (described below). In other embodiments, when the RNAi agent is represented by formula (IIId), the N$_a$ modifications are 2'-O-methyl or 2'-fluoro modifications, n$_p$'>0 and at least one n$_p$' is linked to a neighboring nucleotide via phosphorothioate linkage, the sense strand comprises at least one phosphorothioate linkage, and the sense strand is conjugated to one or more GalNAc derivatives attached through a monovalent, a bivalent or a trivalent branched linker.

In some embodiments, when the dsRNAi agent is represented by formula (IIIa), the N$_a$ modifications are 2'-O-methyl or 2'-fluoro modifications, n$_p$'>0 and at least one n$_p$' is linked to a neighboring nucleotide via phosphorothioate linkage, the sense strand comprises at least one phosphorothioate linkage, and the sense strand is conjugated to one or more GalNAc derivatives attached through a monovalent, a bivalent or a trivalent branched linker.

In some embodiments, the dsRNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, the dsRNAi agent is a multimer containing three, four, five, six, or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two dsRNAi agents represented by at least one of formulas (III), (IIIa), (IIIb), (IIIc), and (IIId) are linked to each other at the 5' end, and one or both of the 3' ends, and are optionally conjugated to a ligand. Each of the agents can target the same gene or two different genes; or each of the agents can target same gene at two different target sites.

Various publications describe multimeric iRNAs that can be used in the methods of the invention. Such publications include U.S. Pat. No. 7,858,769, WO2007/091269, WO2010/141511, WO2007/117686, WO2009/014887, and WO2011/031520 the entire contents of each of which are hereby incorporated herein by reference.

As described in more detail below, the iRNA that contains conjugations of one or more carbohydrate moieties to an iRNA can optimize one or more properties of the iRNA. In many cases, the carbohydrate moiety will be attached to a modified subunit of the iRNA. For example, the ribose sugar of one or more ribonucleotide subunits of a iRNA can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, or polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The iRNA may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl, and decalin; preferably, the acyclic group is a serinol backbone or diethanolamine backbone.

In certain embodiments, the iRNA for use in the methods of the invention for inhibiting the expression of an IGFALS gene is an agent selected from the agents listed in any one of Tables 3, 5, 6, 8, 12, and 14. These agents may further comprise a ligand. These agents may further comprise a ligand.

In certain embodiments, the iRNA for use in the methods of the invention for inhibiting the expression of an IGF-1 gene is an agent selected from the agents listed in any one of Tables 9, 11, 15, 17, 18, and 20. These agents may further comprise a ligand.

III. iRNAs Conjugated to Ligands

Another modification of the RNA of an iRNA of the invention involves chemically linking to the iRNA one or more ligands, moieties or conjugates that enhance the activity, cellular distribution, or cellular uptake of the iRNA e.g., into a cell. For example, the ligand can be attached to the sense strand, antisense strand or both strands, at the 3'-end, 5'-end or both ends. For instance, the ligand may be conjugated to the sense strand. In preferred embodiments, the ligand is conjugated to the 3'-end of the sense strand. Such moieties include but are not limited to lipid moieties such as a cholesterol moiety (Letsinger et al., *Proc. Natl. Acid. Sci. USA,* 1989, 86: 6553-6556), cholic acid (Manoharan et al., *Biorg. Med. Chem. Let.,* 1994, 4:1053-1060). In certain embodiments, the modification can include a thioether, e.g., beryl-S-tritylthiol (Manoharan et al., *Ann. N.Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.,* 1995, 36:3651-3654; Shea et al., *Nucl. Acids Res.,* 1990, 18:3777-3783), a polyamine or a polyethylene glycol chain (Manoharan et al., *Nucleosides & Nucleotides,* 1995, 14:969-973), or adamantane acetic acid (Manoharan et al., *Tetrahedron Lett.,* 1995, 36:3651-3654), a palmityl moiety (Mishra et al., *Biochim. Biophys. Acta,* 1995, 1264:229-237), or an octadecylamine or hexylamino-carbonyloxycholesterol moiety (Crooke et al., *J. Pharmacol. Exp. Ther.,* 1996, 277:923-937).

In certain embodiments, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands do not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, monovalent or multivalent galactose, N-acetyl-galactosamine, N-acetyl-glucoseamine multivalent mannose, multivalent fucose, glycosylated polyaminoacids, transferrin, bisphosphonate, polyglutamate, polyaspartate, a lipid, cholesterol, a steroid, bile acid, folate, vitamin B12, vitamin A, biotin, or an RGD peptide or RGD peptide mimetic. In certain embodiments, ligands include monovalent or multivalent galactose. In certain embodiments, ligands include cholesterol.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases, or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated iRNAs and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates In certain embodiments, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In other embodiments, the lipid based ligand binds HSA weakly or not at all, such that the conjugate will be preferably distributed to the kidney. Other moieties that target to kidney cells can also be used in place of, or in addition to, the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO:24). An RFGF analogue (e.g., amino acid sequence AALLPV-LLAAP (SEQ ID NO:25) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:26) and the Drosophila Antennapedia protein (RQIKIWFQNRRMK-WKK (SEQ ID NO:27) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA further comprises a carbohydrate. The carbohydrate conjugated iRNA is advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri-, and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In certain embodiments, a carbohydrate conjugate for use in the compositions and methods of the invention is a monosaccharide.

In other embodiments, a carbohydrate conjugate for use in the compositions and methods of the invention is selected from the group:

Formula II

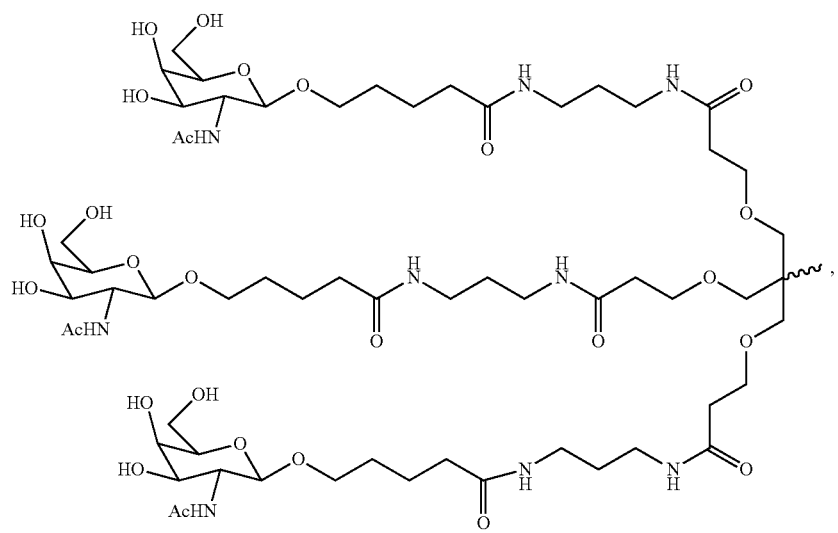

Formula III
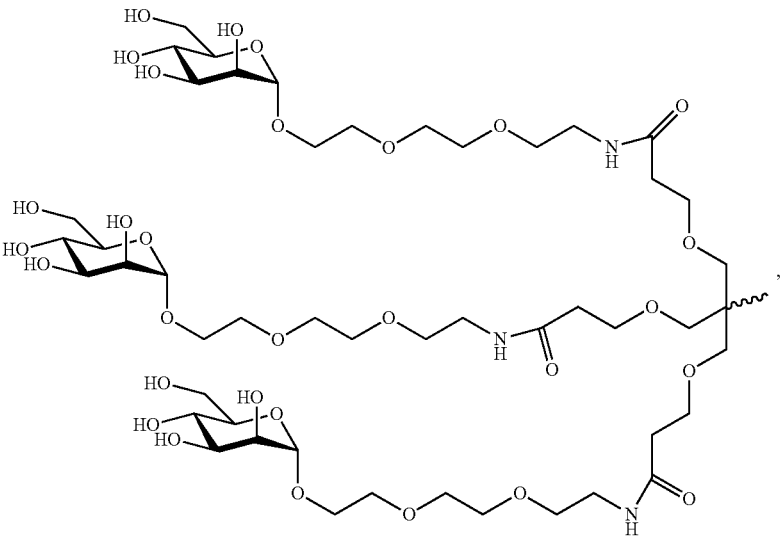
Formula IV
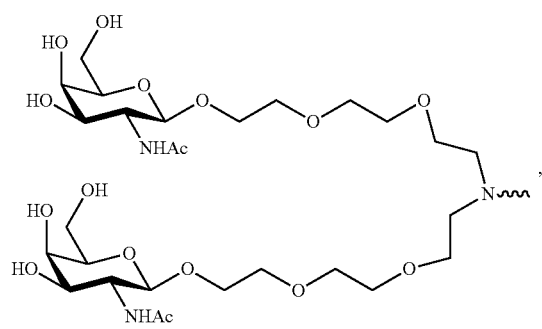
Formula V
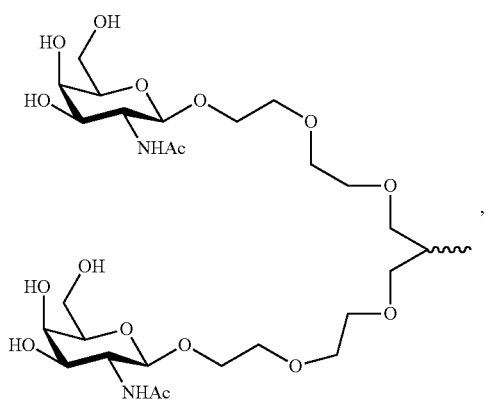
Formula VI
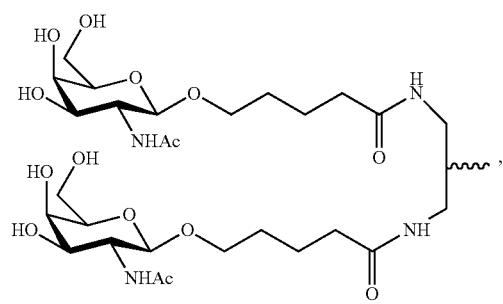
Formula VII
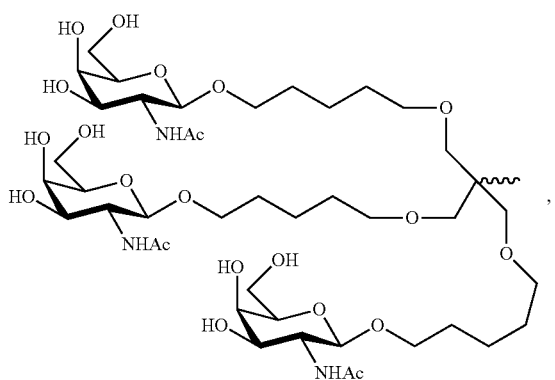
Formula VIII
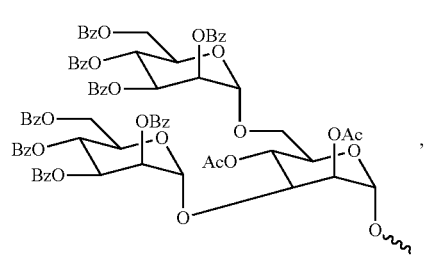

Formula IX
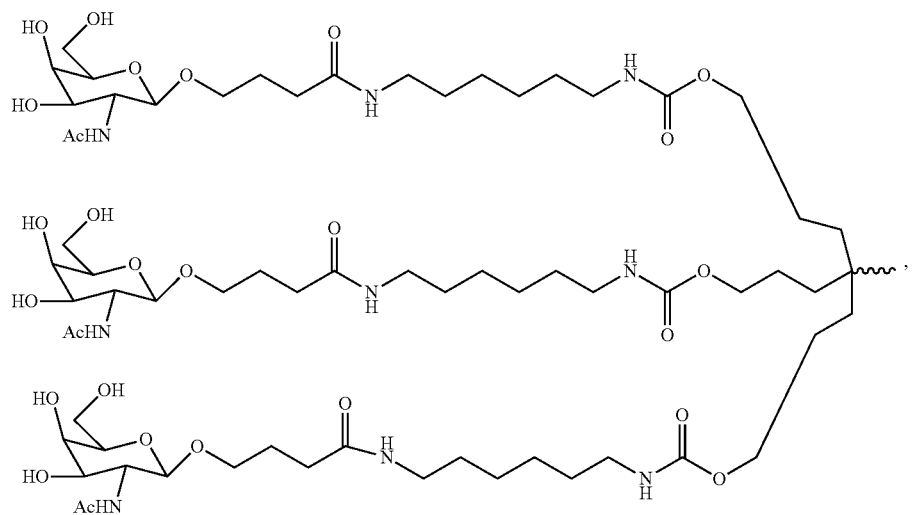
Formula X
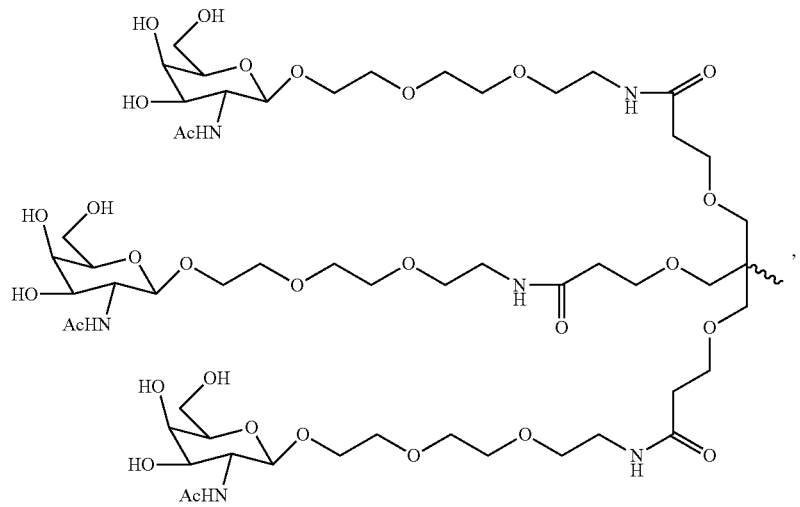
Formula XI
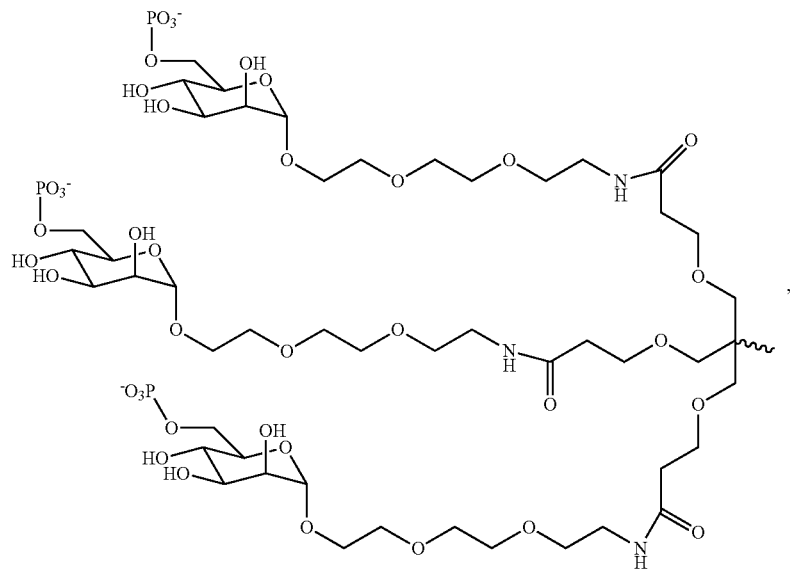

Formula XII
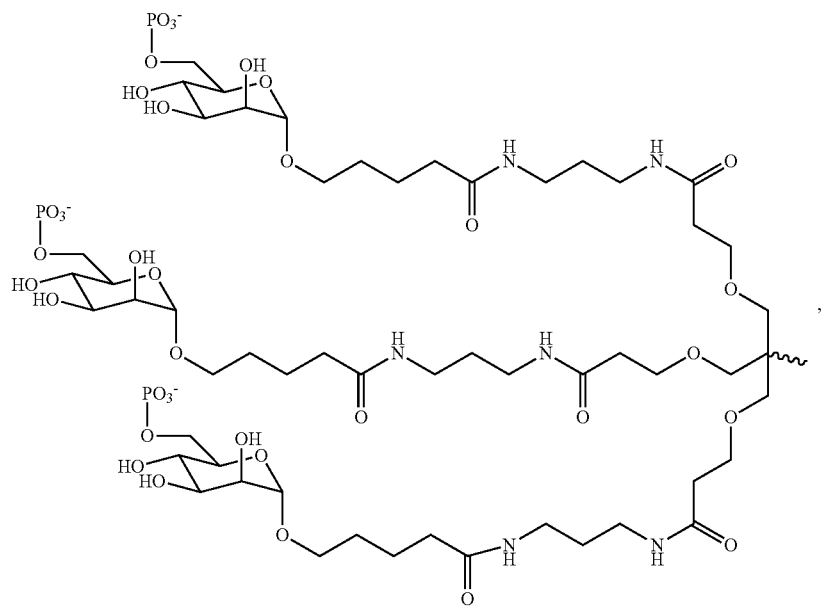
Formula XIII
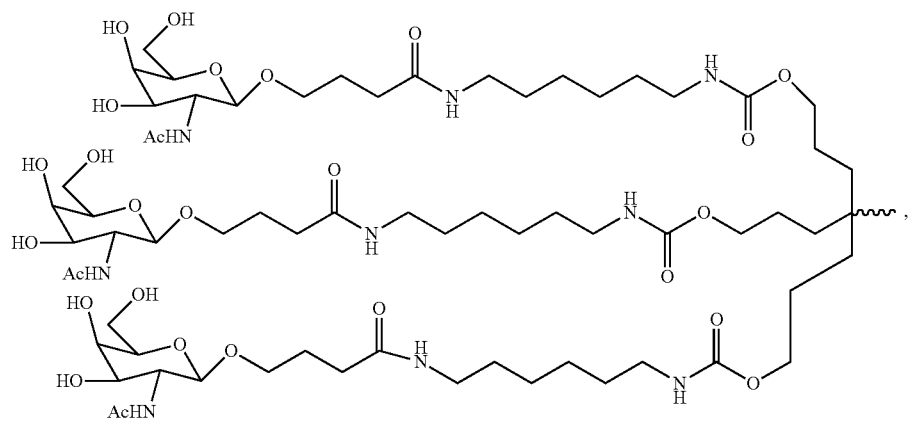
Formula XIV
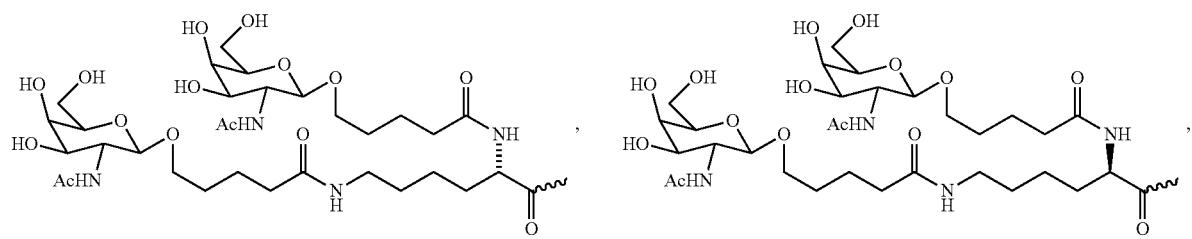
Formula XV
Formula XVI
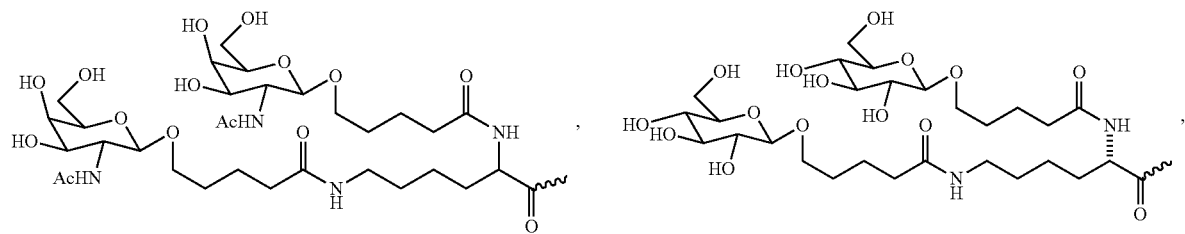
Formula XVII -continued Formula XVIII

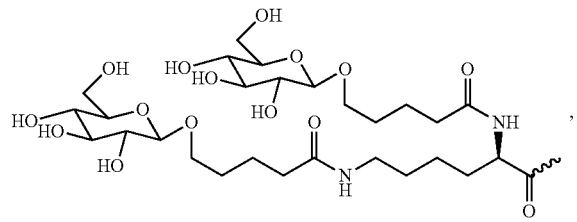

Formula XIX

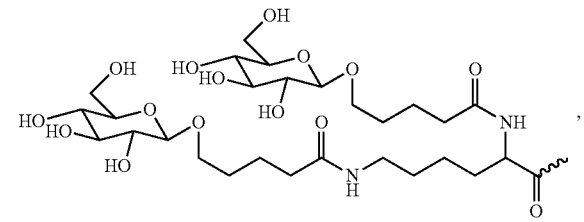

Formula XX

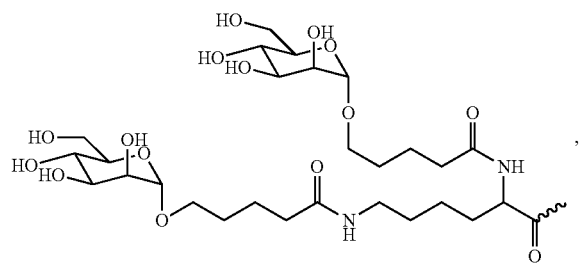

Formula XXI

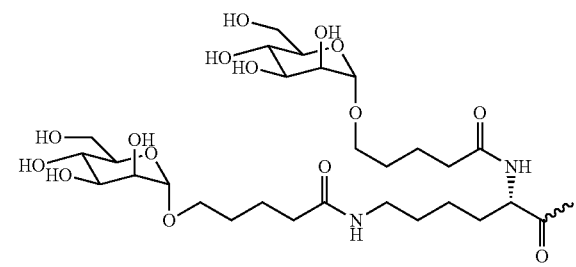

Formula XXII

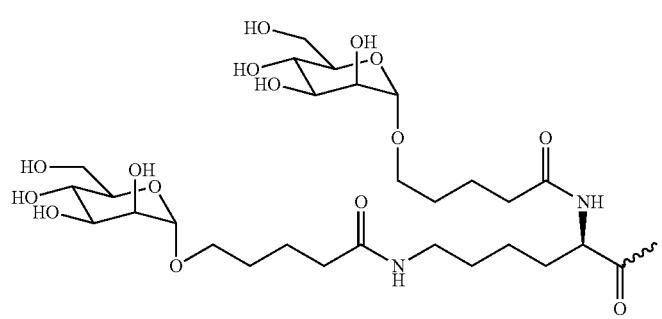

In certain embodiments, the ligand is an N-acetylgalactosamine (GalNAc) or GalNAc derivative. In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one GalNAc or GalNAc derivative attached to the iRNA agent. In another embodiment, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

The GalNAc or GalNAc derivative may be conjugated to the 3' end of the sense strand of the double stranded RNAi agent, the 5' end of the sense strand of the double stranded RNAi agent, the 3' end of the antisense strand of the double stranded RNAi agent, or the 5' end of the antisense strand of the double stranded RNAi agent. In certain embodiments, the monosaccharide is an N-acetylgalactosamine, such as Formula I
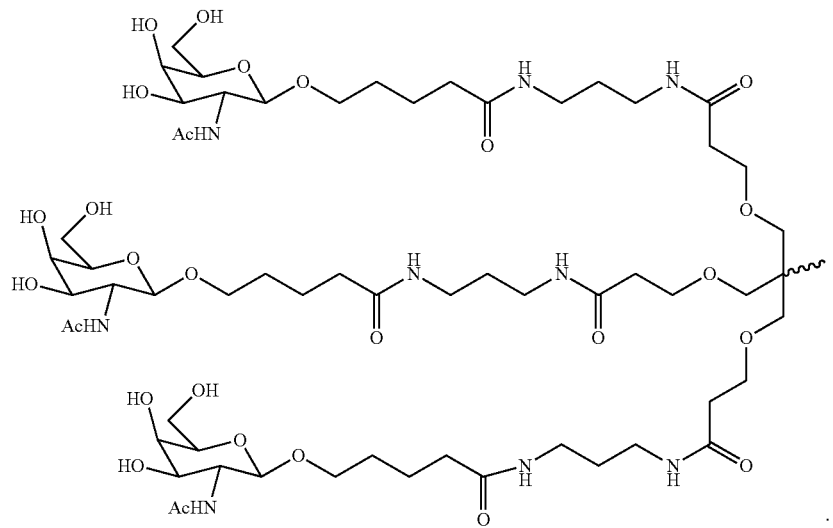 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]
Another representative carbohydrate conjugate for use in the embodiments described herein includes, but is not limited to,

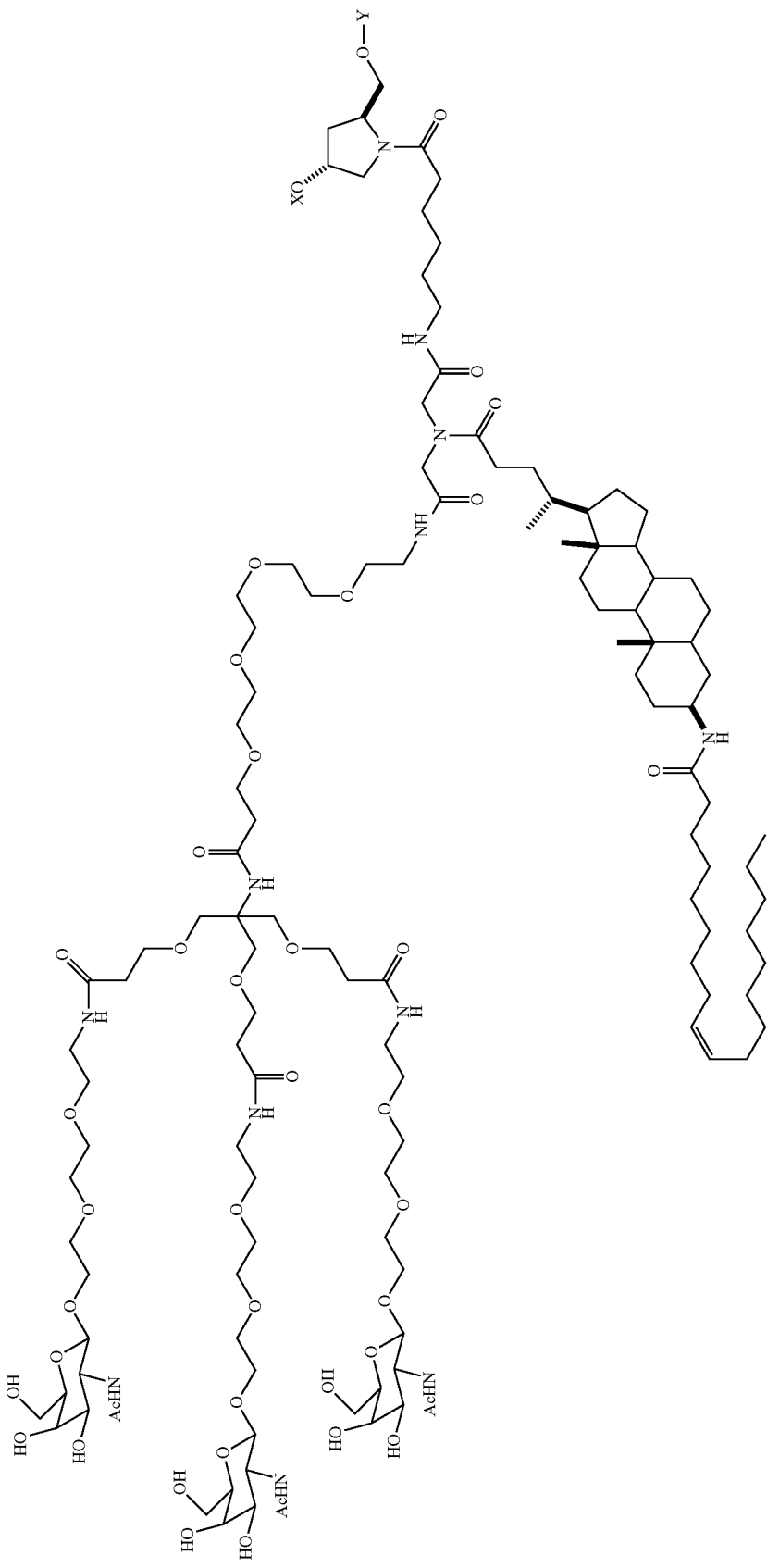

(Formula XXIII), when one of X or Y is an oligonucleotide, the other is a hydrogen.

In some embodiments, the carbohydrate conjugate further comprises one or more additional ligands as described above, such as, but not limited to, a PK modulator or a cell permeation peptide.

Additional carbohydrate conjugates suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, or substituted or unsubstituted heterocyclic; where R8 is hydrogen, acyl, aliphatic, or substituted aliphatic. In one embodiment, the linker is between about 1-24 atoms, 2-24, 3-24, 4-24, 5-24, 6-24, 6-18, 7-18, 8-18, 7-17, 8-17, 6-16, 7-16, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times, or 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (-S-S-). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In other embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are -O-P(O)(ORk)-O-, -O-P(S)(ORk)-O-, -O-P(S)(SRk)-O-, -S-P(O)(ORk)-O-, -O-P(O)(ORk)-S-, -S-P(O)(ORk)-S-, -O-, P(S)(ORk)-S-, -S-P(S)(ORk)-O-, -O-P(O)(Rk)-O-, -O-P(S)(Rk)-O-, -S-P(O)(Rk)-O-, -S-P(S)(Rk)-O-, -S-P(O)(Rk)-S-, -O-P(S)(Rk)-S-. Preferred embodiments are -O-P(O)(OH)-O-, -O-P(S)(OH)-O-, -O-, P(S)(SH)-O-, -S-P(O)(OH)-O-, -O-P(O)(OH)-S-, -S-P(O)(OH)-S-, -O-P(S)(OH)-S-, -S-P(S)(OH)-O-, -O-P(O)(H)-O-, -O-P(S)(H)-O-, -S-P(O)(H)-O, -S-P(S)(H)-O-, -S-P(O)(H)-S-, and -O-P(S)(H)-S-. A preferred embodiment is -O-P(O)(OH)-O-. These candidates can be evaluated using methods analogous to those described above.

iii. Acid Cleavable Linking Groups

In other embodiments, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula -C=NN-, C(O)O, or -OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In other embodiments, a cleavable linker comprises an ester-based cleavable linking group. An ester-based cleavable linking group is cleaved by enzymes such as esterases and amidases in cells. Examples of ester-based cleavable linking groups include, but are not limited to, esters of alkylene, alkenylene and alkynylene groups. Ester cleavable linking groups have the general formula -C(O)O-, or -OC(O)-. These candidates can be evaluated using methods analogous to those described above.

v. Peptide-Based Cleaving Groups

In yet other embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to, (Formula XXIV)
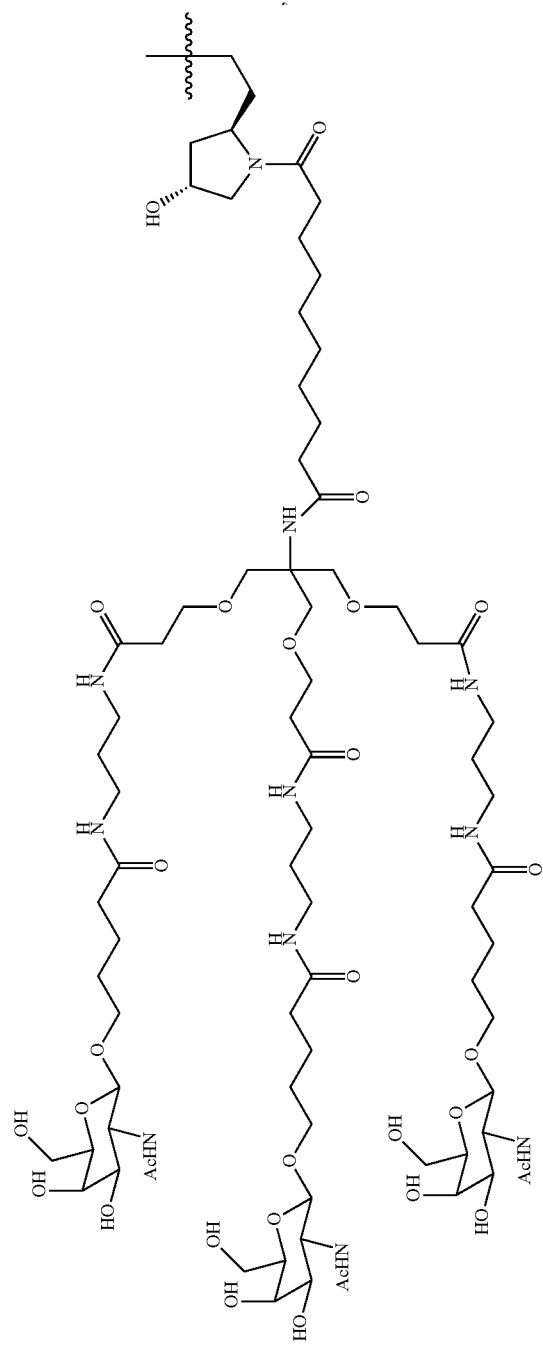

-continued
(Formula XXV)
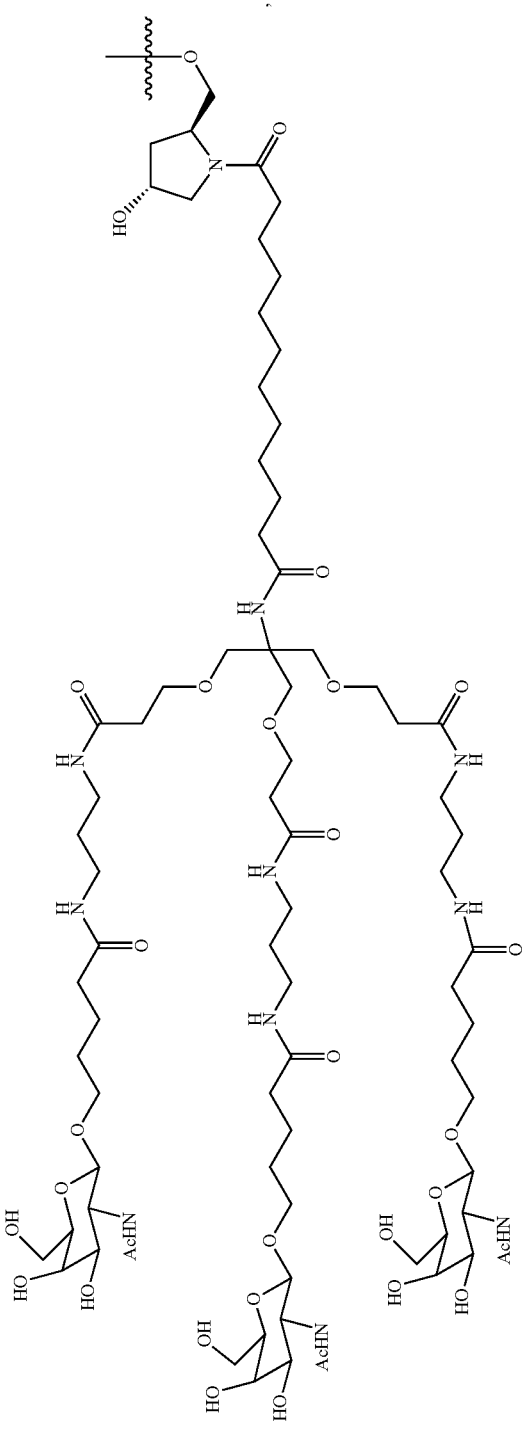
(Formula XXVI)
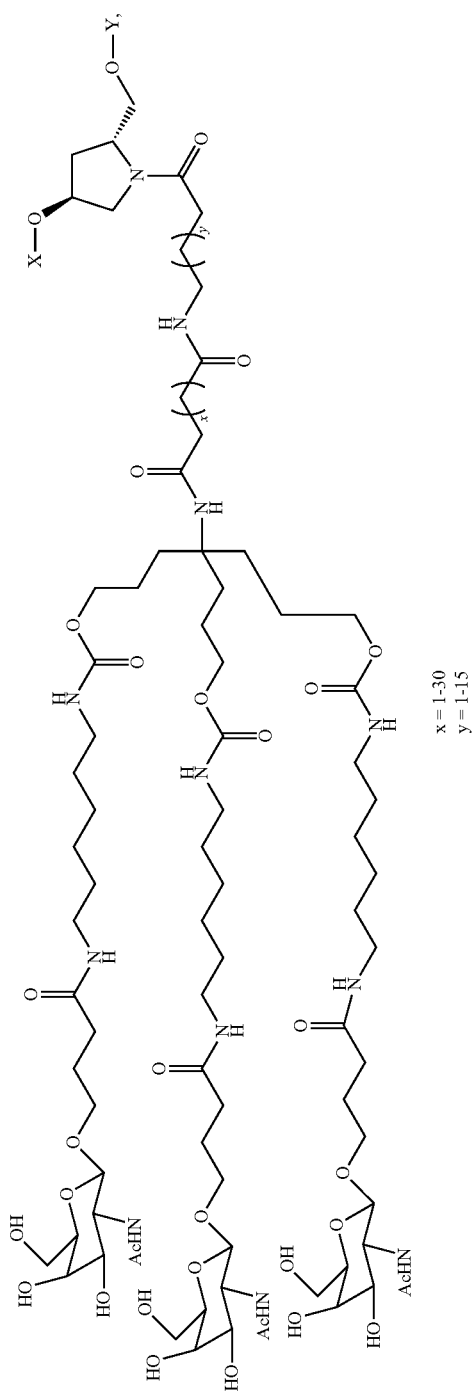
x = 1-30
y = 1-15

-continued
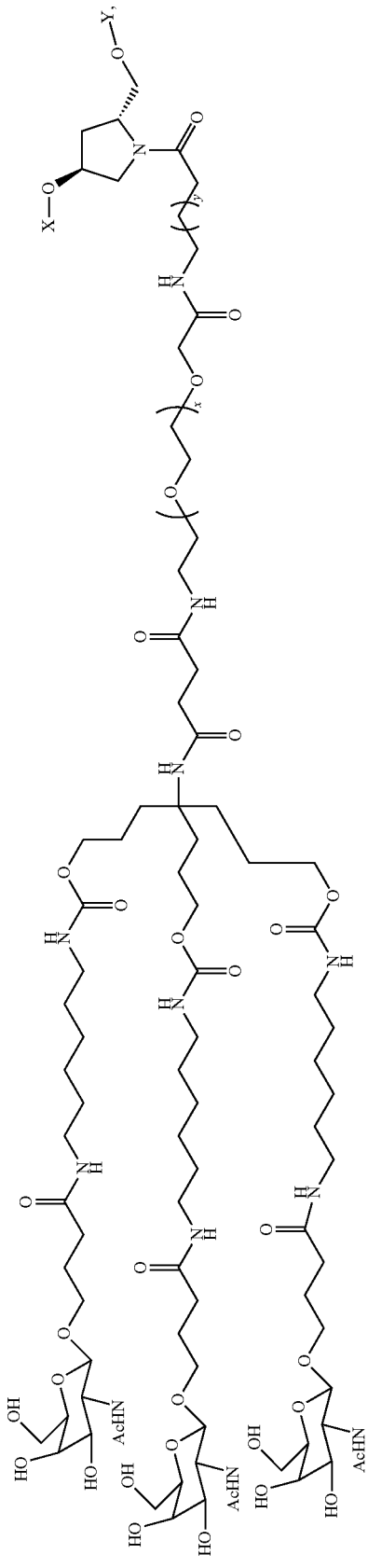
(Formula XXVII)
x = 1-30
y = 1-15
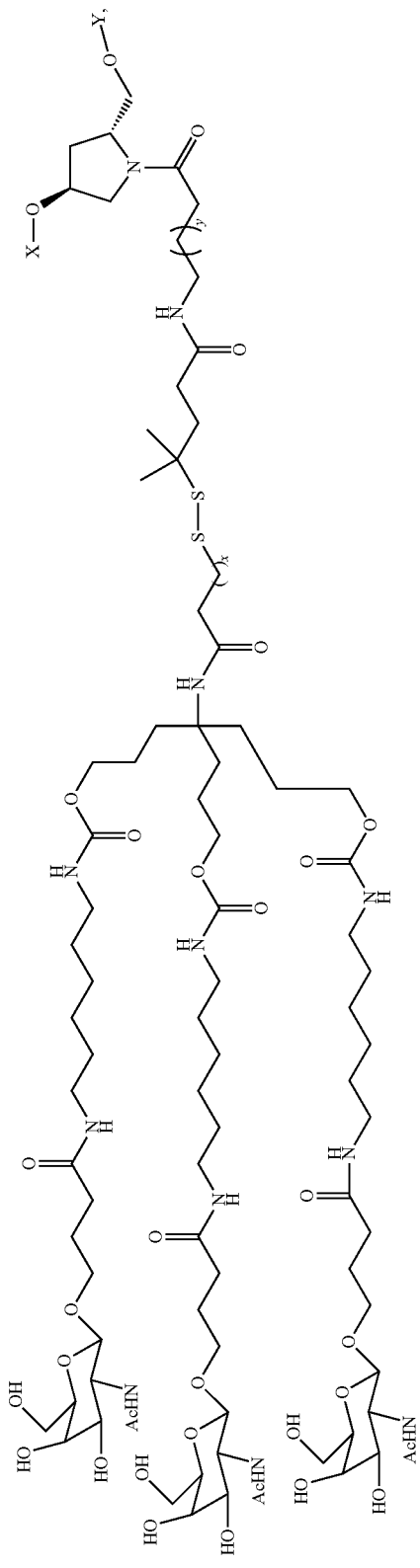
(Formula XXVIII)
x = 0-30
y = 1-15

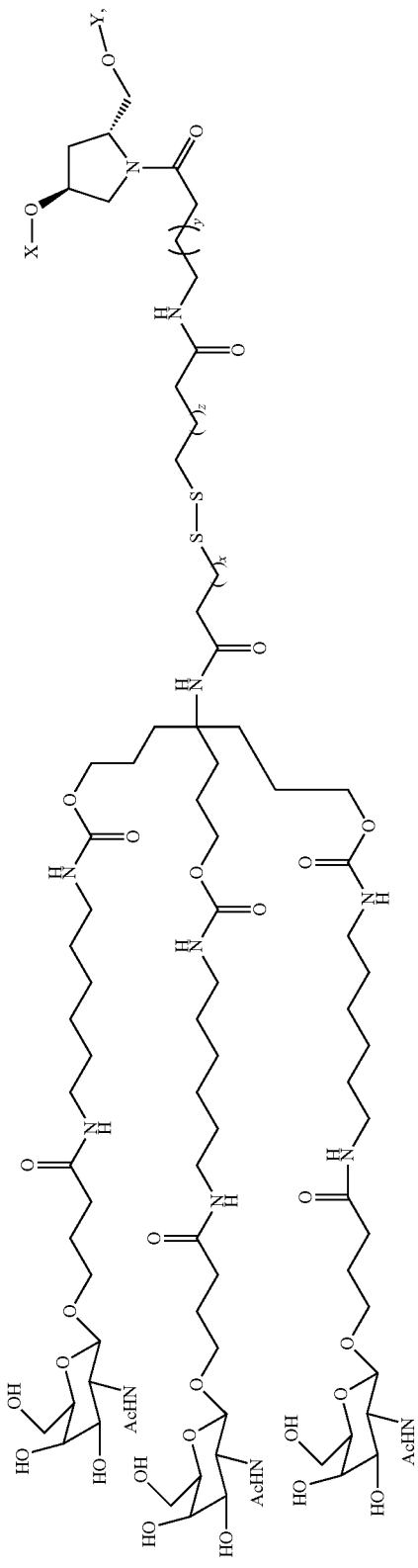
(Formula XXIX)
x = 0-30
y = 1-15
z = 1-20
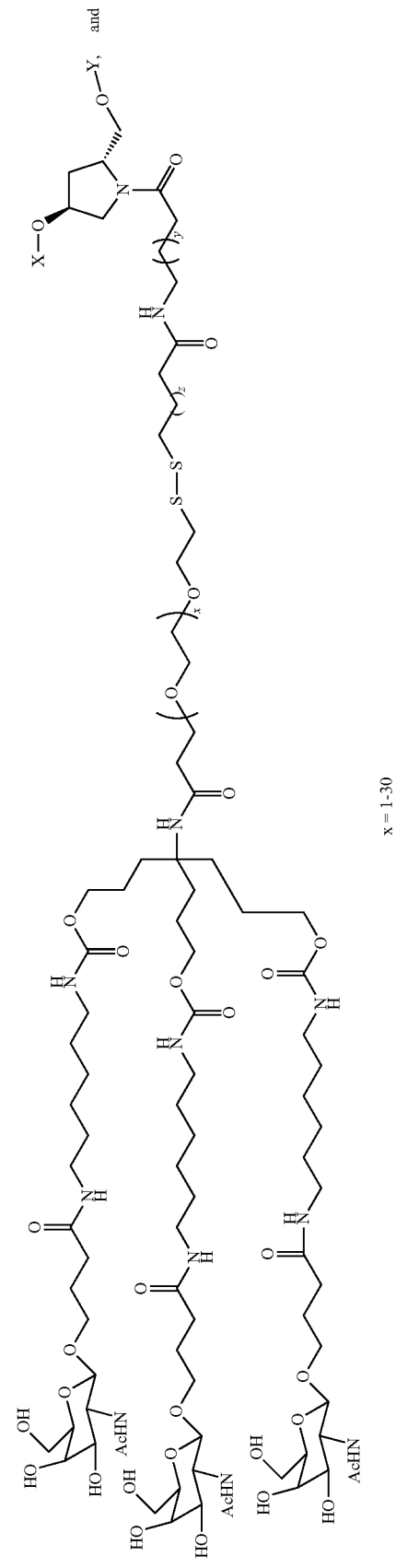
(Formula XXX) and
x = 1-30
y = 1-15
z = 1-20

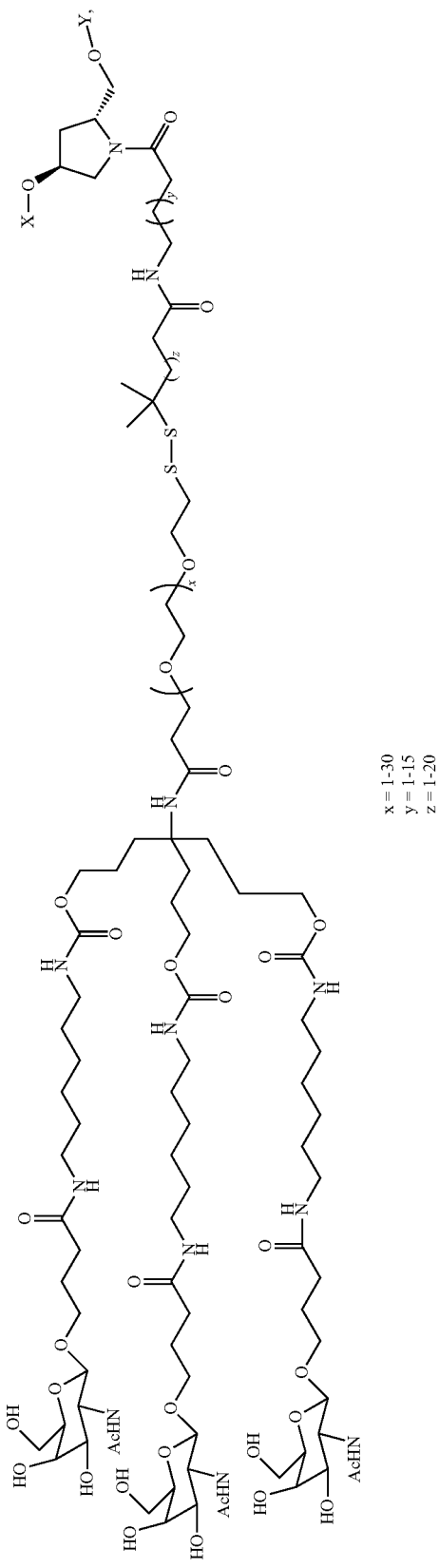
(Formula XXXI)
x = 1-30
y = 1-15
z = 1-20 when one of X or Y is an oligonucleotide, the other is a hydrogen.

In certain embodiments of the compositions and methods of the invention, a ligand is one or more "GalNAc" (N-acetylgalactosamine) derivatives attached through a monovalent, a bivalent or a trivalent branched linker.

In certain embodiments, a dsRNA of the invention is conjugated to a monovalent, a bivalent or a trivalent branched linker selected from the group of structures shown in any of formula (XXXII)-(XXXV):

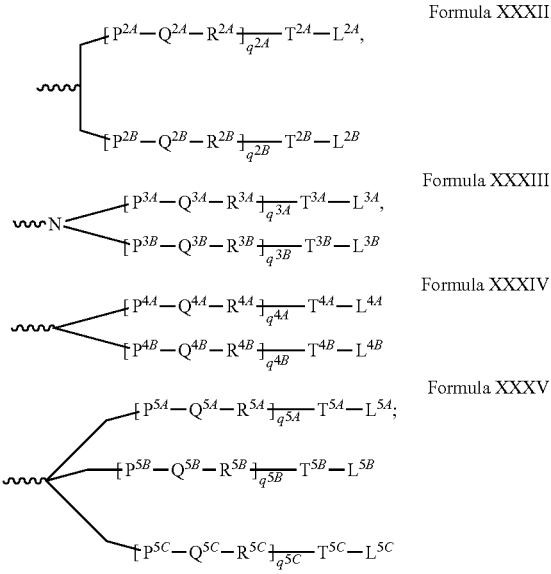

Formula XXXII

Formula XXXIII

Formula XXXIV

Formula XXXV wherein:

q2A, q2B, q3A, q3B, q4A, q4B, q5A, q5B and q5C represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{5A}$, $T^{5B}$, $T^{5C}$ are each independently for each occurrence absent, CO, NH, O, S, OC(O), NHC(O), $CH_2$, $CH_2NH$, or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R"), C≡C, or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, NHCH($R^a$)C(O), -C(O)—CH($R^a$)-NH-, CO, CH=N-O,

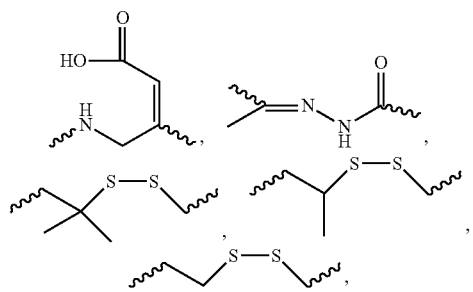

or heterocyclyl;

$L^{2A}$, $L^{2B}$, $L^{3A}$, $L^{3B}$, $L^{4A}$, $L^{4B}$, $L^{5A}$, $L^{5B}$, and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XXXV):

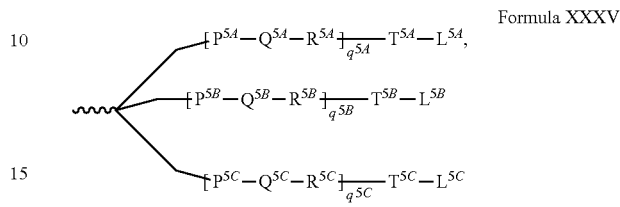

Formula XXXV wherein $L^{5A}$, $L^{5B}$ and $L^{5C}$ represent a monosaccharide, such as GalNAc derivative.

Examples of suitable monovalent, bivalent and trivalent branched linker groups conjugating GalNAc derivatives include, but are not limited to, the structures recited above as formulas II, VII, XI, X, and XIII.

Representative US patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941; 6,294,664; 6,320,017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAi agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.*, 2007, 365(1):54-61; Letsinger et al., *Proc. Natl. Acad. Sci. USA*, 1989, 86:6553), cholic acid (Manoharan et al., *Bioorg. Med. Chem. Lett.*, 1994, 4:1053), a thioether, e.g., hexyl-S-tritylthiol (Manoharan et al., *Ann. N.Y. Acad. Sci.*, 1992, 660:306; Manoharan et al., *Bioorg. Med. Chem. Let.*, 1993, 3:2765), a thiocholesterol (Oberhauser et al., *Nucl. Acids Res.*, 1992, 20:533), an aliphatic chain, e.g., dodecandiol or undecyl residues (Saison-Behmoaras et al., *EMBO J.*, 1991, 10:111; Kabanov et al., *FEBS Lett.*, 1990, 259:327; Svinarchuk et al., *Biochimie*, 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.*, 1995, 36:3651; Shea et al., *Nucl. Acids Res.*, 1990, 18:3777), a polyamine or a polyethylene glycol chain (Manoharan et al., *Nucleosides & Nucleotides*, 1995, 14:969), or adamantane acetic acid (Manoharan et al., *Tetrahedron Lett.*, 1995, 36:3651), a palmityl moiety (Mishra et al., *Biochim. Biophys. Acta*, 1995, 1264:229), or an octadecylamine or hexylamino-carbonyl-oxycholesterol moiety (Crooke et al., *J. Pharmacol. Exp. Ther.*, 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject having a disease, disorder, or condition associated with IGFALS gene or IGF-1 gene expression) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. The non-specific effects of an iRNA can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the iRNA molecule to be administered. Several studies have shown successful knockdown of gene products when a dsRNAi agent is administered locally. For example, intraocular delivery of a VEGF dsRNA by intravitreal injection in cynomolgus monkeys (Tolentino, M J, et al (2004) *Retina* 24:132-138) and subretinal injections in mice (Reich, S J., et al (2003) *Mol. Vis.* 9:210-216) were both shown to prevent neovascularization in an experimental model of age-related macular degeneration. In addition, direct intratumoral injection of a dsRNA in mice reduces tumor volume (Pille, J., et al (2005) *Mol. Ther.* 11:267-274) and can prolong survival of tumor-bearing mice (Kim, W J., et al (2006) *Mol. Ther.* 14:343-350; Li, S., et al (2007) *Mol. Ther.* 15:515-523). RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602) and to the lungs by intranasal administration (Howard, K A., et al (2006) *Mol. Ther.* 14:476-484; Zhang, X., et al (2004) *J. Biol. Chem.* 279:10677-10684; Bitko, V., et al (2005) *Nat. Med.* 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178). Conjugation of an iRNA to an aptamer has been shown to inhibit tumor growth and mediate tumor regression in a mouse model of prostate cancer (McNamara, J O, et al (2006) *Nat. Biotechnol.* 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H, et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R, et al (2003) *J. Mol. Biol* 327:761-766; Verma, U N, et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N, et al (2003), supra), Oligofectamine, "solid nucleic acid lipid particles" (Zimmermann, T S, et al (2006) *Nature* 441:111-114), cardiolipin (Chien, P Y, et al (2005) *Cancer Gene Ther.* 12:321-328; Pal, A, et al (2005) *Int J. Oncol.* 26:1087-1091), polyethyleneimine (Bonnet M E, et al (2008) *Pharm. Res*. August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A, et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector Encoded iRNAs of the Invention iRNA targeting an IGFALS gene or an IGF-1 gene can be expressed from transcription units inserted into DNA or RNA vectors (see, e.g., Couture, A, et al., *TIG*. (1996), 12:5-10; Skillern, A, et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for treating a disease or disorder associated with the expression or activity of an IGFALS gene or an IGF-1 gene. Such pharmaceutical compositions are formulated based on the mode of delivery. One example is compositions that are formulated for systemic administration via parenteral delivery, e.g., by subcutaneous (SC), intramuscular (IM), or intravenous (IV) delivery.

The pharmaceutical compositions of the invention may be administered in dosages sufficient to inhibit expression of an IGFALS gene or an IGF-1 gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, preferably about 0.3 mg/kg and about 3.0 mg/kg. A repeat-dose regimen may include administration of a therapeutic amount of iRNA on a regular basis, such as every other day or once a year. In certain embodiments, the iRNA is administered about once per month to about once per quarter (i.e., about once every three months).

After an initial treatment regimen, the treatments can be administered on a less frequent basis. For example, after administration weekly or biweekly for three months, administration can be repeated once per month, for six months, or a year; or longer.

The pharmaceutical composition can be administered once daily, or the iRNA can be administered as two, three, or more sub-doses at appropriate intervals throughout the day or even using continuous infusion or delivery through a controlled release formulation. In that case, the iRNA contained in each sub-dose must be correspondingly smaller in order to achieve the total daily dosage. The dosage unit can also be compounded for delivery over several days, e.g., using a conventional sustained release formulation which provides sustained release of the iRNA over a several day period. Sustained release formulations are well known in the art and are particularly useful for delivery of agents at a particular site, such as could be used with the agents of the present invention. In this embodiment, the dosage unit contains a corresponding multiple of the daily dose.

In other embodiments, a single dose of the pharmaceutical compositions can be long lasting, such that subsequent doses are administered at not more than 3, 4, or 5 day intervals, or at not more than 1, 2, 3, or 4 week intervals. In some embodiments of the invention, a single dose of the pharmaceutical compositions of the invention is administered once per week. In other embodiments of the invention, a single dose of the pharmaceutical compositions of the invention is administered bi-monthly.

The skilled artisan will appreciate that certain factors can influence the dosage and timing required to effectively treat a subject, including but not limited to the severity of the disease or disorder, previous treatments, the general health or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as known in the art. For example, a mouse model of acromegaly was developed by Kovacs et al. (1997, Endocrinology) the entire contents of which are incorporated herein by reference. Bovine growth hormone transgenic mice also exhibit features of acromegaly (Palmiter et al., *Science* (1983), Olsson et al., *Am J Phys Endo Metab* (2003), Berryman et al, *GH and IGF Res* (2004), Izzard et al., *GH and IGF Res* (2009), Blutke et al., *Mol and Cell Endo* (2014)). Multiple animal models of cancer are known in the art.

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal, or intramuscular injection or infusion; subdermal, e.g., via an implanted device; or intracranial, e.g., by intraparenchymal, intrathecal or intraventricular administration.

The iRNA can be delivered in a manner to target a particular tissue (e.g., liver cells).

Pharmaceutical compositions and formulations for topical or transdermal administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearoylphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof). Topical formulations are described in detail in U.S. Pat. No. 6,747,014, which is incorporated herein by reference.

A. iRNA Formulations Comprising Membranous Molecular Assemblies

An iRNA for use in the compositions and methods of the invention can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the iRNA. The lipophilic material isolates the aqueous interior from an aqueous exterior, which typically does not include the iRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the iRNA are delivered into the cell where the iRNA can specifically bind to a target RNA and can mediate RNA interference. In some cases the liposomes are also specifically targeted, e.g., to direct the iRNA to particular cell types.

A liposome containing an iRNA agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The iRNA agent preparation is then added to the micelles that include the lipid component. The cationic groups on the lipid interact with the iRNA agent and condense around the iRNA agent to form a liposome. After condensation, the detergent is removed, e.g., by dialysis, to yield a liposomal preparation of iRNA agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., *Proc. Natl. Acad. Sci., USA* 8:7413-7417, 1987; U.S. Pat. Nos. 4,897,355; 5,171,678; Bangham, et al. *M. Mol. Biol.* 23:238, 1965; Olson, et al. *Biochim. Biophys. Acta* 557:9, 1979; Szoka, et al. *Proc. Natl. Acad. Sci.* 75: 4194, 1978; Mayhew, et al. *Biochim. Biophys. Acta* 775:169, 1984; Kim, et al. *Biochim. Biophys. Acta* 728:339, 1983; and Fukunaga, et al. *Endocrinol.* 115:757, 1984. Commonly used techniques for preparing lipid aggregates of appropriate size for use as delivery vehicles include sonication and freeze-thaw plus extrusion (see, e.g., Mayer, et al. *Biochim. Biophys. Acta* 858:161, 1986). Microfluidization can be used when consistently small (50 to 200 nm) and relatively uniform aggregates are desired (Mayhew, et al. *Biochim. Biophys. Acta* 775:169, 1984). These methods are readily adapted to packaging iRNA agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al., *Biochem. Biophys. Res. Commun.*, 1987, 147, 980-985).

Liposomes which are pH-sensitive or negatively-charged, entrap nucleic acids rather than complex with it. Since both the nucleic acid and the lipid are similarly charged, repulsion rather than complex formation occurs. Nevertheless, some nucleic acid is entrapped within the aqueous interior of these liposomes. pH-sensitive liposomes have been used to deliver nucleic acids encoding the thymidine kinase gene to cell monolayers in culture. Expression of the exogenous gene was detected in the target cells (Zhou et al., *Journal of Controlled Release*, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of two or more of phospholipid, phosphatidylcholine, and cholesterol.

Examples of other methods to introduce liposomes into cells in vitro and in vivo include U.S. Pat. Nos. 5,283,185 and 5,171,678; WO 94/00569; WO 93/24640; WO 91/16024; Felgner, *J. Biol. Chem.* 269:2550, 1994; Nabel, *Proc. Natl. Acad. Sci.* 90:11307, 1993; Nabel, *Human Gene Ther.* 3:649, 1992; Gershon, *Biochem.* 32:7143, 1993; and Strauss *EMBO J.* 11:417, 1992.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al. *S.T.P. Pharma. Sci.*, 1994, 4(6) 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., *FEBS Letters*, 1987, 223, 42; Wu et al., *Cancer Research*, 1993, 53, 3765).

Various liposomes comprising one or more glycolipids are known in the art. Papahadjopoulos et al. (*Ann. N.Y. Acad. Sci.*, 1987, 507, 64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In some embodiments, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver iRNA agents to macrophages.

Further advantages of liposomes include: liposomes obtained from natural phospholipids are biocompatible and biodegradable; liposomes can incorporate a wide range of water and lipid soluble drugs; liposomes can protect encapsulated iRNAs in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size, and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of iRNA agent (see, e.g., Felgner, P. L. et al., Proc. Natl. Acad. Sci., USA 8:7413-7417, 1987 and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ (Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis (oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS")

(Transfectam™, Promega, Madison, Wis.) and dipalmitoyl-phosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., *Biochim. Biophys. Res. Commun.* 179:280, 1991). Lipopolylysine, made by conjugating polylysine to DOPE, has been reported to be effective for transfection in the presence of serum (Zhou, X. et al., *Biochim. Biophys. Acta* 1065:8, 1991). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer iRNA agent into the skin. In some implementations, liposomes are used for delivering iRNA agent to epidermal cells and also to enhance the penetration of iRNA agent into dermal tissues, e.g., into skin. For example, the liposomes can be applied topically. Topical delivery of drugs formulated as liposomes to the skin has been documented (see, e.g., Weiner et al., *Journal of Drug Targeting*, 1992, vol. 2,405-410 and du Plessis et al., *Antiviral Research*, 18, 1992, 259-265; Mannino, R. J. and Fould-Fogerite, S., Biotechniques 6:682-690, 1988; Itani, T. et al. *Gene* 56:267-276. 1987; Nicolau, C. et al. *Meth. Enz.* 149:157-176, 1987; Straubinger, R. M. and Papahadjopoulos, D. *Meth. Enz.* 101:512-527, 1983; Wang, C. Y. and Huang, L., *Proc. Natl. Acad. Sci. USA* 84:7851-7855, 1987).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver a drug into the dermis of mouse skin. Such formulations with iRNA agent are useful for treating a dermatological disorder.

Liposomes that include iRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include iRNAs can be delivered, for example, subcutaneously by infection in order to deliver iRNAs to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present invention are described in WO/2008/042973.

Transfersomes are yet another type of liposomes, and are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in "Pharmaceutical Dosage Forms", Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in "Pharmaceutical Dosage Forms", Marcel Dekker, Inc., New York, N.Y., 1988, p. 285).

The iRNA for use in the methods of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of iRNA, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the RNAi and at least the alkali metal alkyl sulphate. The first micellar composition is then mixed with at least three micelle forming compounds to form a mixed micellar composition. In another method, the micellar composition is prepared by mixing the RNAi, the alkali metal alkyl sulphate and at least one of the micelle forming compounds, followed by addition of the remaining micelle forming compounds, with vigorous mixing.

Phenol or m-cresol may be added to the mixed micellar composition to stabilize the formulation and protect against bacterial growth. Alternatively, phenol or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles iRNAs, e.g., dsRNAi agents of the invention may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; US Publication No. 2010/0324120 and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid can be, for example, N,N-dioleyl-N,N-dimethylammonium chloride (DODAC), N,N-distearyl-N,N-dimethylammonium bromide (DDAB), N-(I-(2,3-dioleoyloxy)propyl)-N,N,N-trimethylammonium chloride (DOTAP), N-(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-

Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis (2-hydroxydodecyl)amino)ethyl)(2-hydroxydodecyl)amino) ethyl)piperazin-1-yl)ethylazanediyl)didodecan-2-ol (Tech G1), or a mixture thereof. The cationic lipid can comprise from about 20 mol % to about 50 mol % or about 40 mol % of the total lipid present in the particle.

In some embodiments, the compound 2,2-Dilinoleyl-4-dimethylaminoethyl-[1,3]-dioxolane can be used to prepare lipid-siRNA nanoparticles.

In some embodiments, the lipid-siRNA particle includes 40% 2,2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The ionizable/non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-l-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid can be from about 5 mol % to about 90 mol %, about 10 mol %, or about 58 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate can be, for example, a PEG-dilauryloxypropyl ($C_{12}$), a PEG-dimyristyloxypropyl ($C_{14}$), a PEG-dipalmityloxypropyl ($C_{16}$), or a PEG-distearyloxypropyl ($C_{18}$). The conjugated lipid that prevents aggregation of particles can be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In one embodiment, the lipidoid ND98.4HCl (MW 1487) (see US20090023673, which is incorporated herein by reference), Cholesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

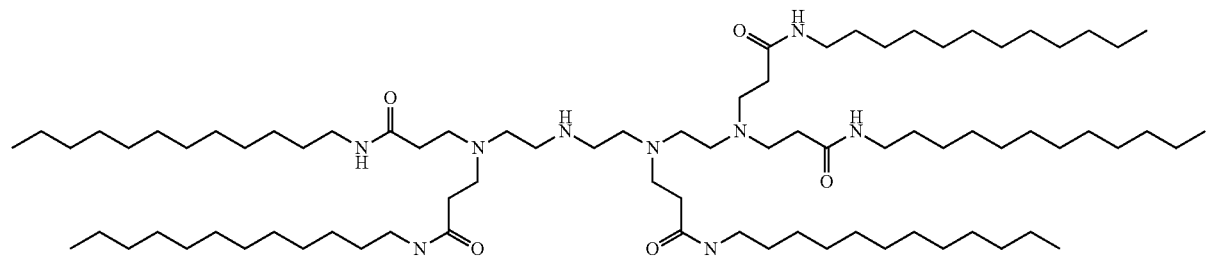

ND98 Isomer I

LNP01 formulations are described, e.g., in International Application Publication No. WO 2008/042973, which is hereby incorporated by reference.

Additional exemplary lipid-dsRNA formulations are described in Table 1.

TABLE 1

Exemplary lipid formulations

| | Ionizable/Cationic Lipid | cationic lipid/non-cationic lipid/cholesterol/PEG-lipid conjugate Lipid:siRNA ratio |
|---|---|---|
| SNALP-1 | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)—N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000)
SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described, e.g., in International Application No. PCT/US2010/022614, filed Jan. 29, 2010, which is hereby incorporated by reference.

MC3 comprising formulations are described, e.g., in US Patent Publication No. 2010/0324120, filed Jun. 10, 2010, the entire contents of which are hereby incorporated by reference.

ALNY-100 comprising formulations are described, e.g., International patent application number PCT/US09/63933, filed on Nov. 10, 2009, which is hereby incorporated by reference.

C12-200 comprising formulations are described in WO2010/129709, which is hereby incorporated by reference.

Compositions and formulations for oral administration include powders or granules, microparticulates, nanoparticulates, suspensions, or solutions in water or non-aqueous media, capsules, gel capsules, sachets, tablets or minitablets. Thickeners, flavoring agents, diluents, emulsifiers, dispersing aids, or binders can be desirable. In some embodiments, oral formulations are those in which dsRNAs featured in the invention are administered in conjunction with one or more penetration enhancer surfactants and chelators. Suitable surfactants include fatty acids or esters or salts thereof, bile acids or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG), and starches; polyalkylcyanoacrylates; DEAE-derivatized polyimines, pollulans, celluloses, and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular, or intrahepatic administration can include sterile aqueous solutions which can also contain buffers, diluents, and other suitable additives such as, but not limited to, penetration enhancers, carrier compounds, and other pharmaceutically acceptable carriers or excipients.

Pharmaceutical compositions of the present invention include, but are not limited to, solutions, emulsions, and liposome-containing formulations. These compositions can be generated from a variety of components that include, but are not limited to, preformed liquids, self-emulsifying solids, and self-emulsifying semisolids. Formulations include those that target the liver when treating hepatic disorders such as hepatic carcinoma.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous or mixed media. Aqueous suspensions can further contain substances which increase the viscosity of the suspension including, for example, sodium carboxymethylcellulose, sorbitol, or dextran. The suspension can also contain stabilizers.

C. Additional Formulations i. Emulsions

The iRNAs of the present invention can be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution either in the aqueous phase, oily phase or itself as a separate phase. Pharmaceutical excipients such as emulsifiers, stabilizers, dyes, and antioxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic, and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin, and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate, and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives, and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral, and parenteral routes, and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins, and high fat nutritive preparations are among the materials that have commonly been administered orally as o/w emulsions.

ii. Microemulsions

In one embodiment of the present invention, the iRNAs are formulated as microemulsions. A microemulsion can be defined as a system of water, oil, and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij® 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex® 300, Captex® 355, Capmul® MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils, and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill® 3), Labrasol®, and penetration enhancers to improve the properties of the formulation and to enhance the absorption of the iRNAs and nucleic acids of the present invention. Penetration enhancers used in the microemulsions of the present invention can be classified as belonging to one of five broad categories-surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An iRNA of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Such compounds are well known in the art.

v. Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent, or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc.).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone, and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone, and the like.

vii. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions can contain substances which increase the viscosity of the suspension including, for example, sodium carboxymethylcellulose, sorbitol, or dextran. The suspension can also contain stabilizers.

In some embodiments, pharmaceutical compositions featured in the invention include (a) one or more iRNA and (b) one or more agents which function by a non-iRNA mechanism and which are useful in treating an IGFALS or IGF-1-associated disorder.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50 with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents effective in treatment of pathological processes mediated by IGFALS or IGF-1 expression. In any event, the administering physician can adjust the amount and timing of iRNA administration on the basis of results observed using standard measures of efficacy known in the art or described herein.

VI. Methods of the Invention

The present invention also provides methods of inhibiting expression of an IGFALS gene or IGF-1 gene in a cell. The methods include contacting a cell with an RNAi agent, e.g., double stranded RNAi agent, in an amount effective to inhibit expression of IGFALS or IGF-1 in the cell, thereby inhibiting expression of IGFALS or IGF-1 in the cell.

Contacting of a cell with an iRNA, e.g., a double stranded RNAi agent, may be done in vitro or in vivo. Contacting a cell in vivo with the iRNA includes contacting a cell or group of cells within a subject, e.g., a human subject, with the iRNA. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In preferred embodiments, the targeting ligand is a carbohydrate moiety, e.g., a GalNAc$_3$ ligand, or any other ligand that directs the RNAi agent to a site of interest.

The term "inhibiting," as used herein, is used interchangeably with "reducing," "silencing," "downregulating", "suppressing", and other similar terms, and includes any level of inhibition.

The phrase "inhibiting expression of an IGFALS or "inhibiting expression of an IGF-1" is intended to refer to inhibition of expression of any IGFALS gene or IGF-1 gene (such as, e.g., a mouse IGFALS gene or IGF-1 gene, a rat IGFALS gene or IGF-1 gene, a monkey IGFALS gene or IGF-1 gene, or a human IGFALS gene or IGF-1 gene) as well as variants or mutants of an IGFALS gene or IGF-1 gene. Thus, the IGFALS gene or IGF-1 gene may be a wild-type IGFALS gene or IGF-1 gene, a mutant IGFALS gene or IGF-1 gene (such as a mutant IGFALS gene or IGF-1 gene), or a transgenic IGFALS gene or IGF-1 gene in the context of a genetically manipulated cell, group of cells, or organism.

"Inhibiting expression of an IGFALS gene" or "inhibiting expression of an IGF-1 gene" includes any level of inhibition of an IGFALS gene or an IGF-1 gene, e.g., at least partial suppression of the expression of an IGFALS gene or an IGF-1 gene. The expression of the IGFALS gene or an IGF-1 genemay be assessed based on the level, or the change in the level, of any variable associated with IGFALS gene or an IGF-1 geneexpression, e.g., IGFALS mRNA or IGF-1 mRNA level or an IGFALS protein level or an IGF-1 protein level. This level may be assessed in an individual cell or in a group of cells, including, for example, a sample derived from a subject.

Inhibition may be assessed by a decrease in an absolute or relative level of one or more variables that are associated with IGFALS or IGF-1 expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of an IGFALS or IGF-1 gene is inhibited by at least 30%, 35%, 40%, 45%, 50%, 55%, 60%, 65%, 70%, 75%, 80%, 85%, 90%, or 95%, or to below the level of detection of the assay. In some embodiments, the inhibition of expression of an IGFALS gene or an IGF-1 gene results in normalization of the level of IGF-1 such that the difference between the level before treatment and a normal control level is reduced by at least 30%, 35%, 40%, 45%, 50%, 55%, 60%, 65%, 70%, 75%, 80%, 85%, 90%, or 95%.

Inhibition of the expression of an IGFALS gene or an IGF-1 gene may be manifested by a reduction of the amount of mRNA expressed by a first cell or group of cells (such cells may be present, for example, in a sample derived from a subject) in which an IGFALS gene or an IGF-1 gene is transcribed and which has or have been treated (e.g., by contacting the cell or cells with an iRNA of the invention, or by administering an iRNA of the invention to a subject in which the cells are or were present) such that the expression of an IGFALS gene or an IGF-1 gene is inhibited, as compared to a second cell or group of cells substantially identical to the first cell or group of cells but which has not or have not been so treated (control cell(s) not treated with an iRNA or not treated with an iRNA targeted to the gene of interest). In preferred embodiments, the inhibition is assessed by the method provided in Example 2 and expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

In other embodiments, inhibition of the expression of an IGFALS gene or an IGF-1 gene may be assessed in terms of a reduction of a parameter that is functionally linked to IGFALS or IGF-1 gene expression, e.g., IGFALS or IGF-1 protein expression or IGF signaling pathways. IGFALS or IGF-1 gene silencing may be determined in any cell expressing IGFALS or IGF-1, either endogenous or heterologous from an expression construct, and by any assay known in the art.

Inhibition of the expression of an IGFALS or IGF-1 protein may be manifested by a reduction in the level of the IGFALS or IGF-1 protein that is expressed by a cell or group of cells (e.g., the level of protein expressed in a sample derived from a subject). As explained above, for the assessment of mRNA suppression, the inhibition of protein expression levels in a treated cell or group of cells may similarly be expressed as a percentage of the level of protein in a control cell or group of cells.

A control cell or group of cells that may be used to assess the inhibition of the expression of an IGFALS or IGF-1 gene includes a cell or group of cells that has not yet been contacted with an RNAi agent of the invention. For example, the control cell or group of cells may be derived from an individual subject (e.g., a human or animal subject) prior to treatment of the subject with an RNAi agent.

In certain embodiments, inhibition of expression of an IGF-1 gene may be manifested in a reduction in the difference between a normal level of IGF-1 mRNA or protein and an abnormal level of IGF-1 mRNA or protein in a subject or in a specific tissue in the subject, e.g., mRNA in the liver of the subject or IGF-1 protein in subject serum. That is, inhibition may be manifested in a normalization of expression as compared to an appropriate control.

The level of IGFALS mRNA or IGF-1 mRNA that is expressed by a cell or group of cells, or the level of circulating IGFALS mRNA or IGF-1 mRNA, may be determined using any method known in the art for assessing mRNA expression. In one embodiment, the level of expression of IGFALS or IGF-1 in a sample is determined by detecting a transcribed polynucleotide, or portion thereof, e.g., mRNA of the IGFALS gene or IGF-1 gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene (PreAnalytix, Switzerland). Typical assay formats utilizing ribonucleic acid hybridization include nuclear run-on assays, RT-PCR, RNase protection assays, northern blotting, in situ hybridization, and microarray analysis. Circulating IGFALS or IGF-1 mRNA may be detected using methods the described in PCT Publication WO2012/177906, the entire contents of which are hereby incorporated herein by reference.

In some embodiments, the level of expression of IGFALS or IGF-1 is determined using a nucleic acid probe. The term "probe", as used herein, refers to any molecule that is capable of selectively binding to a specific IGFALS or IGF-1. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to IGFALS mRNA or IGF-1 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in determining the level of IGFALS mRNA or IGF-1 mRNA.

An alternative method for determining the level of expression of IGFALS or IGF-1 in a sample involves the process of nucleic acid amplification and/or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) Proc. Natl. Acad. Sci. USA 88:189-193), self sustained sequence replication (Guatelli et al. (1990) Proc. Natl. Acad. Sci. USA 87:1874-1878), transcriptional amplification system (Kwoh et al. (1989) Proc. Natl. Acad. Sci. USA 86:1173-1177), Q-Beta Replicase (Lizardi et al. (1988) Bio/Technology 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of IGFALS or IGF-1 is determined by quantitative fluorogenic RT-PCR (i.e., the TaqMan™ System).

The expression levels of IGFALS or IGF-1 mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of IGFALS or IGF-1 expression level may also comprise using nucleic acid probes in solution.

In preferred embodiments, the level of mRNA expression is assessed using branched DNA (bDNA) assays or real time PCR (qPCR). The use of these methods is described and exemplified in the Examples presented herein.

The level of IGFALS or IGF-1 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like.

In some embodiments, the efficacy of the methods of the invention in the treatment of an IGF system-associated disease is assessed by a decrease in IGFALS mRNA or IGF-1 mRNA level (by liver biopsy) or IGFALS or IGF-1 protein level, typically determined in serum.

In some embodiments, the efficacy of the methods of the invention in the treatment of acromegaly can be monitored by evaluating a subject for normalization of at least one sign or symptom of acromegaly previously displayed in the subject including, elevated IGF-1 level, sleep apnea, joint pain, symptomatic carpal tunnel syndrome, hypertension, biventricular cardiac hypertrophy, cardiac arrhythmia, fatigue, and weakness. These symptoms may be assessed in vitro or in vivo using any method known in the art. Although the nadir GH suppression ofter administration of glucose can be considered the "gold standard" test for acromegaly (Katznelson et al., 2011, Endocrine Practice), suppression may not be observed after treatment with the RNAi agents provided herein due to their proposed mechanism of action. Moreover, subjects may have accomplished clinically relevant beneficial outcomes with lowering of IGF-1 without reaching normal GH levels.

It is understood that normal IGF-1 levels are dependent both on the age and gender of the subject, with younger subjects having lower IGF-1 levels than older subjects. Therefore, when comparing IGF-1 levels to determine the lowering or normalizing of the level, an appropriate control must be selected. Appropriate controls include, for example, an IGF-1 level prior to treatment (when available) or an age and gender matched control. In certain embodiments, IGF-1 levels are monitored or tested on multiple occasions to confirm a change in IGF-1 level in a subject. In preferred embodiments, the IGF-1 level is decreased sufficiently to provide a clinically beneficial outcome for the subject.

In some embodiments, the efficacy of the method of the invention in treatment of cancer can be monitored by evaluating a subject for maintenance or preferably reduction of tumor burden of the primary tumor or metastatic tumor(s) or the prevention of metastasis. Methods for detection and monitoring of tumor burden are known in the art, e.g., RECIST criteria as provided in Eisenhauer et al., 2009, New response evaluation criteria in solid tumours: Revised RECIST guideline (version 1.1). Eur. J. Cancer. 45:228-247.

In some embodiments of the methods of the invention, the iRNA is administered to a subject such that the iRNA is delivered to a specific site within the subject. The inhibition of expression of IGFALS or IGF-1 may be assessed using measurements of the level or change in the level of IGFALS or IGF-1 mRNA or IGFALS or IGF-1 protein in a sample derived from fluid or tissue from the specific site within the subject.

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

VII. Methods of Treating or Preventing IGF System-Associated Diseases

The present invention also provides methods of using an iRNA of the invention or a composition containing an iRNA of the invention to reduce or inhibit IGFALS or IGF-1 expression in a cell. The methods include contacting the cell with a dsRNA of the invention and maintaining the cell for a time sufficient to obtain degradation of the mRNA transcript of an IGFALS gene or an IGF-1 gene, thereby inhibiting expression of the IGFALS gene or an IGF-1 gene in the cell. Reduction in gene expression can be assessed by any methods known in the art. For example, a reduction in the expression of IGFALS or IGF-1 may be determined by determining the mRNA expression level of IGFALS or IGF-1, e.g., in a liver sample, using methods routine to one of ordinary skill in the art, e.g., northern blotting, qRT-PCR; by determining the protein level of IGFALS or IGF-1 using methods routine to one of ordinary skill in the art, such as western blotting, immunological techniques. A reduction in the expression of IGFALS or IGF-1 may also be assessed indirectly by measuring a decrease in biological activity of IGFALS or IGF-1 or measuring the level of IGF-1 in a subject sample (e.g., a serum sample).

In the methods of the invention the cell may be contacted in vitro or in vivo, i.e., the cell may be within a subject.

A cell suitable for treatment using the methods of the invention may be any cell that expresses an IGFALS or IGF-1 gene, typically a liver cell. A cell suitable for use in the methods of the invention may be a mammalian cell, e.g., a primate cell (such as a human cell or a non-human primate cell, e.g., a monkey cell or a chimpanzee cell), a non-primate cell (such as a cow cell, a pig cell, a camel cell, a llama cell, a horse cell, a goat cell, a rabbit cell, a sheep cell, a hamster, a guinea pig cell, a cat cell, a dog cell, a rat cell, a mouse cell, a lion cell, a tiger cell, a bear cell, or a buffalo cell), a bird cell (e.g., a duck cell or a goose cell), or a whale cell. In one embodiment, the cell is a human cell, e.g., a human liver cell.

IGFALS expression or IGF-1expression is inhibited in the cell by at least 30%, 35%, 40%, 45%, 50%, 55%, 60%, 65%, 70%, 75%, 80%, 85%, 90%, or 95%, or to a level below the level of detection of the assay. IGFALS expression or IGF-1expression is inhibited in the cell such that the difference between the level of expression in a subject with an IGF system-associated disease and the normal level of expression is reduce by at least 30%, 35%, 40%, 45%, 50%, 55%, 60%, 65%, 70%, 75%, 80%, 85%, 90%, or 95%.

The in vivo methods of the invention may include administering to a subject a composition containing an iRNA, where the iRNA includes a nucleotide sequence that is complementary to at least a part of an RNA transcript of the IGFALS gene or IGF-1 gene of the mammal to be treated. When the organism to be treated is a mammal such as a human, the composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of IGFALS or IGF-1, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the iRNA to the liver.

The mode of administration may be chosen based upon whether local or systemic treatment is desired and based upon the area to be treated. The route and site of administration may be chosen to enhance targeting.

In one aspect, the present invention also provides methods for inhibiting the expression of an IGFALS or IGF-1 gene in a mammal. The methods include administering to the mammal a composition comprising a dsRNA that targets an IGFALS or an IGF-1 gene in a cell of the mammal and maintaining the mammal for a time sufficient to obtain degradation of the mRNA transcript of the IGFALS gene or the IGF-1 gene, thereby inhibiting expression of the IGFALS gene or the IGF-1 gene in the cell. Reduction in gene expression can be assessed by any methods known it the art and by methods, e.g. qRT-PCR, described herein. Reduction in protein production can be assessed by any methods known it the art and by methods, e.g. ELISA, described herein. In one embodiment, a puncture liver biopsy sample serves as the tissue material for monitoring the reduction in the IGFALS gene or the IGF-1 gene or protein expression.

The present invention further provides methods of treatment of a subject in need thereof. The treatment methods of the invention include administering an iRNA of the invention to a subject, e.g., a subject that would benefit from a reduction or inhibition of IGFALS or IGF-1 expression, in a therapeutically effective amount of an iRNA targeting an IGFALS gene or an IGF-1 gene or a pharmaceutical composition comprising an iRNA targeting an IGFALS gene or an IGF-1 gene.

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from a reduction or inhibition of IGFALS gene or an IGF-1 gene expression are those having a disorder of elevated growth hormone, e.g., acromegaly, or a disorder of elevated insulin signaling, e.g., cancer. In another embodiment, a subject having a disorder of elevated growth hormone has one or more signs or symptoms associated with acromegaly or elevated growth hormone including, but not limited to, elevated IGF-1 level, somatic enlargement (soft tissue and bony overgrowth), excessive sweating, jaw overgrowth, sleep apnea, osteoarthropathy, joint pain, symptomatic carpal tunnel syndrome, hypertension, biventricular cardiac hypertrophy, cardiac arrhythmia, fatigue, weakness, diabetes mellitus, menstrual irregularities in women and sexual dysfunction in men, headache, and visual field loss (attributable to optic chiasmal compression) and diplopia (due to cranial nerve palsy); in conjunction with an elevated growth hormone level. Treatment of a subject that would benefit from a reduction or inhibition of IGFALS or IGF-1 gene expression and normalization of growth hormone levels includes therapeutic treatment (e.g., of a subject is suffering from acromegaly) and prophylactic treatment (e.g., of a subject does not meet the diagnostic criteria of acromegaly or may have elevated or fluctuating growth hormone, or IGFALS, or IGF-1 levels, or a subject may be at risk of developing acromegaly). Treatment of a subject that would benefit from a reduction or inhibition of IGFALS gene expression or IGF-1 gene expression can also include treatment of cancer.

The invention further provides methods for the use of an iRNA or a pharmaceutical composition thereof, e.g., for treating a subject that would benefit from reduction or inhibition of IGFALS or IGF-1 expression, e.g., a subject having a disorder of elevated growth hormone, in combination with other pharmaceuticals or other therapeutic methods, e.g., with known pharmaceuticals or known therapeutic methods, such as, for example, those which are currently employed for treating these disorders. For example, in certain embodiments, an iRNA targeting IGFALS or IGF-1 is administered in combination with an agent useful in treating a disorder of elevated growth hormone as described elsewhere herein.

The invention provides methods for the treatment of cancer, e.g., IGF-1 dependent cancer, IGF-1 receptor positive cancer, or metastatic or potentially metastatic cancer. In certain embodiments, the iRNAs of the invention are used in conjunction with various standards of treatment of cancer, e.g., chemotherapeutic agents, surgery, radiation; and combinations thereof.

The iRNA and additional therapeutic agents may be administered at the same time or in the same combination, e.g., parenterally, or the additional therapeutic agent can be administered as part of a separate composition or at separate times or by another method known in the art or described herein.

In one embodiment, the method includes administering a composition featured herein such that expression of the target IGFALS gene or IGF-1 gene is decreased, such as for about 1, 2, 3, 4, 5, 6, 7, 8, 12, 16, 18, 24 hours, 28, 32, or about 36 hours. In one embodiment, expression of the target IGFALS gene or IGF-1 gene is decreased for an extended duration, e.g., at least about two, three, four days or more, e.g., about one week, two weeks, three weeks, or four weeks or longer.

Preferably, the iRNAs useful for the methods and compositions featured herein specifically target RNAs (primary or processed) of the target IGFALS gene or IGF-1 gene. Compositions and methods for inhibiting the expression of these genes using iRNAs can be prepared and performed as described herein.

Administration of the iRNA according to the methods of the invention may result in a reduction of the severity, signs, symptoms, or markers of such diseases or disorders in a patient with a disorder of elevated growth hormone, elevated IGFALS, elevated IGF-1, or an IGF-1 responsive tumor. By "reduction" in this context is meant a statistically significant decrease in such level. The reduction can be, for example, at least about 30%, 35%, 40%, 45%, 50%, 55%, 60%, 65%, 70%, 75%, 80%, 85%, 90%, or 95%, or to below the level of detection of the assay used.

Efficacy of treatment or prevention of disease can be assessed, for example by measuring disease progression, disease remission, symptom severity, reduction in pain, quality of life, dose of a medication required to sustain a treatment effect, level of a disease marker, or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of a disorder of IGF signaling may be assessed, for example, by periodic monitoring of IGF-1 or IGFALS levels, e.g., serum IGF-1 or IGFALS levels. For subjects suffering from acromegaly a decrease in one or more signs or symptoms including, but not limited to sleep apnea, joint pain, symptomatic carpal tunnel syndrome, hypertension, biventricular cardiac hypertrophy, cardiac arrhythmia, fatigue, and weakness can be an indication of treatment of acromegaly. Similarly a delay or lessening of the severity of the co-morbidities associated with acromegaly such as hypertension, hypertrophy, stroke, diabetes, and sleep apnea can demonstrate efficacy of treatment.

Efficacy of treatment of cancer can be demonstrated by stabilization or a decrease in tumor burden as demonstrated by a stabilization or decrease in tumor burden of the primary tumor, metastatic tumors, or the delay or prevention of tumor metastasis. Diagnostic and monitoring methods are known in the art and are also provided herein.

Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an iRNA targeting IGFALS or IGF-1, or pharmaceutical composition thereof, "effective against" an IGF system-associated disorder indicates that administration in a clinically appropriate manner results in a beneficial effect for at least a statistically significant fraction of patients, such as a improvement of symptoms, a cure, a reduction in disease, extension of life, improvement in quality of life, or other effect generally recognized as positive by medical doctors familiar with treating IGF system-associated disorders.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale. Any positive change resulting in e.g., lessening of severity of disease measured using the appropriate scale, represents adequate treatment using an iRNA or iRNA formulation as described herein.

Subjects can be administered a therapeutic amount of iRNA, such as about 0.01 mg/kg to about 200 mg/kg.

The iRNA can be administered by intravenous infusion over a period of time, on a regular basis. In certain embodiments, after an initial treatment regimen, the treatments can be administered on a less frequent basis. Administration of the iRNA can reduce IGFALS or IGF-1 levels, e.g., in a cell, tissue, blood, urine, or other compartment of the patient by at least 20%, 25%, 30%, 35%, 40%, 45%, 50%, 55%, 60%, 65%, 70%, 75%, 80%, 85%, 90%, or 95%, or below the level of detection of the assay method used. It is noted that a reduction in IGFALS will not likely result in a decrease in growth hormone levels in a subject with acromegaly. Administration of the iRNA can reduce the difference in the subject IGF-1 levels and a normal IGF-1 level, e.g., in a cell, tissue, blood, urine, or other compartment of the patient by at least 20%, 25%, 30%, 35%, 40%, 45%, 50%, 55%, 60%, 65%, 70%, 75%, 80%, 85%, 90%, or 95%.

Before administration of a full dose of the iRNA, patients can be administered a smaller dose, such as a 5% infusion reaction, and monitored for adverse effects, such as an allergic reaction. In another example, the patient can be monitored for unwanted immunostimulatory effects, such as increased cytokine (e.g., TNF-alpha or INF-alpha) levels.

Alternatively, the iRNA can be administered subcutaneously, i.e., by subcutaneous injection. One or more injections may be used to deliver the desired daily dose of iRNA to a subject. The injections may be repeated over a period of time. The administration may be repeated on a regular basis. In certain embodiments, after an initial treatment regimen, the treatments can be administered on a less frequent basis. A repeat-dose regimen may include administration of a therapeutic amount of iRNA on a regular basis, such as every other day or to once a year. In certain embodiments, the iRNA is administered about once per month to about once per quarter (i.e., about once every three months).

IX. Diagnostic Criteria and Treatment for Acromegaly

Diagnostic criteria for acromegaly are set forth in the American Association of Clinical Endocrinologists Medical Guidelines for Clinical Practice for the Diagnosis and Treatment of Acromegaly-2011 Update (Katznelson et al., Endocr. Pract. 17 (Suppl. 4), incorporated herein by reference. Further details and citations can be found therein.

Acromegaly is a clinical syndrome that, depending on its stage of progression, may not manifest with clear diagnostic features. Diagnosis should be considered in patients with 2 or more of the following comorbidities: new-onset diabetes, diffuse arthralgias, new-onset or difficult-to-control hypertension, cardiac disease including biventricular hypertrophy and diastolic or systolic dysfunction, fatigue, headaches, carpal tunnel syndrome, sleep apnea syndrome, diaphoresis, loss of vision, colon polyps, and progressive jaw malocclusion. A serum IGF-I level, if accompanied by a large number of results from age- and sex-matched normal subjects, is a good tool to assess integrated GH secretion and is excellent for diagnosis, monitoring, and especially screening. A random IGF-I value (a marker of integrated GH secretion) should be measured for diagnosis and for monitoring after a therapeutic intervention. Serum GH assays are not standardized and should not be used interchangably. The nadir GH suppression after administration of glucose has been considered the "gold standard" test for acromegaly, however, a conflict exists regarding the threshold for diagnosis. The panel recommends that GH measurements be performed at baseline, then every 30 minutes for a total of 120 minutes after administration of glucose. The inability to suppress serum GH to less than 1 ng/mL after glucose administration is typically considered the diagnostic criterion for acromegaly, however, in a consensus guideline in 2000, the diagnosis of acromegaly was excluded if the patient had a random GH measurement less than 0.4 ng/mL and a normal IGF-I value. Although a nadir GH concentration of less than 1 ng/mL after administration of glucose is the standard recommendation for a normal response, the 2011 panel suggests consideration of a lower nadir GH cut point at 0.4 ng/mL after glucose administration because of the enhanced assay sensitivity and more frequent finding of modest GH hypersecretion. A diagnosis of acromegaly will be made by one of skill in the art considering the totality of the evidence for the patient under consideration.

Once a biochemical diagnosis of acromegaly has been made, a magnetic resonance imaging (MRI) scan of the pituitary gland should be performed because a pituitary GH-secreting adenoma is the most common cause of acromegaly. Visual field testing should be performed if there is optic chiasmal compression noted on the MRI or if the patient has complaints of reduced peripheral vision. Further biochemical testing should include a serum prolactin level (to evaluate for hyperprolactinemia) and assessment of anterior and posterior pituitary function (for potential hypopituitarism).

The goals of therapy for acromegaly are to (1) control biochemical indices of activity, (2) control tumor size and prevent local mass effects, (3) reduce signs and symptoms of disease, (4) prevent or improve medical comorbidities, and (5) prevent early mortality. The primary mode of therapy is surgery, which is recommended for all patients with microadenomas and for all patients who have macroadenomas with associated mass effects. In patients with macroadenomas without mass effects, and with low likelihood of surgical cure, a role for surgical de-bulking of macroadenomas to improve the response to subsequent medical therapy has been advocated, as well as primary medical therapy alone. Medical therapy is generally used in the adjuvant setting. Irradiation, either conventional fractionated RT or stereotactic radiosurgery, is largely relegated to an adjuvant role. Availability of specific therapeutic options and cost of these interventions are taken into account with decisions regarding therapy.

The goal of surgical interventions is to decrease tumor volume, thereby decreasing production of excess growth hormone and decompress the mass effect of macroadenomas on any normal remaining pituitary gland tissues, optic nerve, or surrounding critical structures. Surgical interventions can be curative for many subjects. Surgically resected tissue should be analyzed to understand the tumor biology to potentially provide guidance for treatment. Biochemical analyses are also performed post-operatively to assess the surgical outcome.

Medical therapy is used in conjunction with surgery. Studies have provided conflicting results regarding the benefits of treatment with medical interventions prior to surgery to change the nature of the tumor. The iRNAs provided herein can be used at any time in conjunction with surgical intervention (i.e., before or after surgery).

Adjunctive medical therapy is used in patients who cannot achieve a complete cure by surgical intervention. Medical therapies fall into three categories: dopamine agonists, somatostatin analogs (SSAs), and a GH receptor antagonist. Each of the medical interventions presents different risks and benefits, including substantial costs of some of the therapies.

Dopamine agonists include cabergoline and bromocriptine. The agents are a good first line therapy, especially in patients with mild biochemical activity, as they are realtively inexpensive and orally administered. However, side effects include gastrointestinal upset, orthostatic hypotension, headache, and nasal congestion.

Somatostatin analogs (SSAs) include octreotide (Sandostatin®) LAR (long-acting release, administered as an intramuscular injection) and lanreotide (Somatuline®) Autogel (administered as a deep subcutaneous depot injection). SSAs are less convenient for use than dopamine agonists as they must be administered by injection (50 mcg three times daily Sandostatin® Injection subcutaneously for 2 weeks followed by Sandostatin® LAR 20 mg intragluteally every 4 weeks for 3 months; or 60, 90, or 120 mg of Somatuline® every 28 days by deep subcutaneous injection). SSAs are effective in normalizing IGF-I and GH levels in approximately 55% of patients. The clinical and biochemical responses to SSAs are inversely related to tumor size and degree of GH hypersecretion. Octreotide LAR and lanreotide Autogel have similar efficacy profiles. In patients with an inadequate response to SSAs, the addition of cabergoline or pegvisomant (Somavert®) may be effective for further lowering one or both of GH and IGF-1 levels. Potential side effects of SSAs, include gastrointestinal upset, malabsorption, constipation, gallbladder disease, hair loss, and bradycardia.

Pegvisomant, a GH receptor antagonist, is administered by daily subcutaneous injection. Side effects of pegvisomant, include flulike illness, allergic reactions, and increase in liver enzymes. Patients treated with pegvisomant must undergo routine liver enzyme tests. Because endogenous GH levels increase with pegvisomant administration and pegvisomant may be cross-measured in GH assays, serum GH levels are not specific and should not be monitored in patients receiving pegvisomant. Instead, serum IGF-1 levels are monitored.

Combinations of various medical therapies may be useful in the treatment of some acromegaly patients.

Radiation therapy is used as an adjunctive treatment is patients who do not respond sufficiently to surgical or medical interventions.

Similar treatment strategies are used in children with gigantism, a type of acromegaly, which refers to excess GH secretion that occurs during childhood when the growth plates are open, leading to accelerated vertical growth.

Some of the comorbidities of acromegaly resolve upon decreasing the level of GH or decreasing the responsiveness of the subject to GH. However, others are not. Unlike soft tissue changes, bone enlargement is not reversible. Surgical interventions (e.g., carpal tunnel release, joint replacement surgery), physical therapy, and analgesic medications can be used to treat conditions associated with bone or soft tissue overgrowth. Respiratory disorders including sleep apnea and higher susceptibility to respiratory infections can be treated with standard interventions and preventive strategies (e.g., influenza and pneumococcal vaccinations). Cardiovascular disease, hypertension, and stroke can be managed using standard monitoring (e.g., blood pressure, cholesterol, and lipid level monitoring) and medical treatment. Subjects should be monitored for the development of type 2 diabetes and neoplasia, particularly colon polyps and neoplasia. Subjects should also be monitored for psychological complications related to the physical changes and deformities that can occur with the disease. As used herein, treatment can include, but does not require, resolution of the co-morbidities of acromegaly. Treatment can include, but does not require, prevention or reduction of the development of one or more of the comorbidities associated with acromegaly. As used herein, treatment for acromegaly can further include, but does not require, treatment of one or more of the comorbidities associated with acromegaly.

IX. Response Evaluation Criteria and Treatment of Cancer

Methods for detection of tumors and assessment of tumor burden are well known in the art. For example, the Response Evaluation Criteria in Solid Tumors (RECIST) guidelines were revised in 2008 and are fully set forth in Eisenhauer et al., 2009, New response evaluation criteria in solid tumours: Revised RECIST guideline (version 1.1). Eur. J. Cancer. 45:228-247. These guidelines can be used to determine if a subject has tumor regression or no tumor progression as demonstrated by a complete response (CR) or partial response (PR), or stable disease (SD), respectively, as provided therein for at least a sufficient time that the CR, PR, or SD is detected meets the threshold of treatment or effective treatment as provided herein. A subject with only progressive disease (PD) after administration of an iRNA provided herein is not considered to have a favorable response to or be effectively treated by the iRNA. The development of PD after a period of CR, PR, or PD is understood as having been effectively treated by the iRNA provided herein.

It is understood that the iRNA agents provided herein can be used in conjunction with other interventions for the treatment of cancer, e.g., surgery, chemotherapy, or radiation.

This invention is further illustrated by the following examples which should not be construed as limiting. The entire contents of all references, patents and published patent applications cited throughout this application, as well as the Figure and Sequence Listing, are hereby incorporated herein by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

IGFALS Transcripts and siRNA Design

A set of siRNAs targeting the human IGFALS, "insulin-like growth factor binding protein, acid labile subunit", (human: NCBI refseqID NM_004970; NCBI GeneID: 3483), as well as toxicology-species IGFALS orthologs (cynomolgus monkey: XM_005590898; mouse: NM_008340; rat, NM_053329) were designed using custom R and Python scripts. The human NM_004970 REFSEQ mRNA has a length of 2168 bases.

The rationale and method for the set of siRNA designs is as follows: the predicted efficacy for every potential 19mer siRNA from position 50 through position 2160 (the coding region and 3' UTR) was determined with a linear model derived the direct measure of mRNA knockdown from more than 20,000 distinct siRNA designs targeting a large number of vertebrate genes. Subsets of the IGFALS siRNAs were designed with perfect or near-perfect matches between human, cynomolgus and rhesus monkey. A further subset was designed with perfect or near-perfect matches to mouse and rat IGFALS orthologs. For each strand of the siRNA, a custom Python script was used in a brute force search to measure the number and positions of mismatches between the siRNA and all potential alignments in the target species transcriptome. Extra weight was given to mismatches in the seed region, defined here as positions 2-9 of the antisense oligonucleotide, as well the cleavage site of the siRNA, defined here as positions 10-11 of the antisense oligonucleotide. The relative weight of the mismatches was 2.8; 1.2:1 for seed mismatches, cleavage site, and other positions up through antisense position 19. Mismatches in the first position were ignored. A specificity score was calculated for each strand by summing the value of each weighted mismatch. Preference was given to siRNAs whose antisense score in human and cynomolgus monkey was >=2.0 and predicted efficacy was >=50% knockdown of the IGFALS transcript.

A detailed list of the unmodified IGFALS sense and antisense strand sequences is shown in Tables 3, 6, and 12.

A detailed list of the modified IGFALS sense and antisense strand sequences is shown in Tables 5, 8, and 14.

IGF-1 Transcripts and siRNA Design

A set of siRNAs targeting the human insulin like growth factor 1, "IGF1" (human: e.g., NCBI refseqID NM_000618; NCBI GeneID: 3479), as well as toxicology-species IGF1 orthologs (cynomolgus monkey: e.g., XM_005572039; mouse: e.g., NM_010512; rat, e.g., NM_178866) were designed using custom R and Python scripts. The human NM_00618 REFSEQ mRNA has a length of 7366 bases.

The rationale and method for the set of siRNA designs is as follows: the predicted efficacy for every potential 19mer siRNA from position 265 through position 7366 (the coding region and 3' UTR) was determined with a linear model derived the direct measure of mRNA knockdown from more than 20,000 distinct siRNA designs targeting a large number of vertebrate genes. Subsets of the IGF1 siRNAs were designed with perfect or near-perfect matches between human and cynomolgus monkey. A further subset was designed with perfect or near-perfect matches to human, cynomolgus monkey and mouse IGF1 orthologs. A further subset was designed with perfect or near-perfect matches to mouse and rat IGF1 orthologs. For each strand of the siRNA, a custom Python script was used in a brute force search to measure the number and positions of mismatches between the siRNA and all potential alignments in the target species transcriptome. Extra weight was given to mismatches in the seed region, defined here as positions 2-9 of the antisense oligonucleotide, as well the cleavage site of the siRNA, defined here as positions 10-11 of the antisense oligonucleotide. The relative weight of the mismatches was 2.8; 1.2:1 for seed mismatches, cleavage site, and other positions up through antisense position 19. Mismatches in the first position were ignored. A specificity score was calculated for each strand by summing the value of each weighted mismatch. Preference was given to siRNAs whose antisense score in human and cynomolgus monkey was >=3.0 and predicted efficacy was >=70% knockdown of the human IGF1 transcripts.

A detailed list of the unmodified IGF-1 sense and antisense strand sequences is shown in Tables 9, 15, and 18.

A detailed list of the modified IGF-1 sense and antisense strand sequences is shown in Tables 11, 17, and 20.

siRNA Synthesis siRNA sequences were synthesized at 1 µmol scale on a Mermade 192 synthesizer (BioAutomation) using the solid support mediated phosphoramidite chemistry. The solid support was controlled pore glass (500 A) loaded with custom GalNAc ligand or universal solid support (AM biochemical). Ancillary synthesis reagents, 2'-F and 2'-O-Methyl RNA and deoxy phosphoramidites were obtained from Thermo-Fisher (Milwaukee, Wis.) and Hongene (China). 2'F 2'-O-Methyl, GNA (glycol nucleic acids), 5'phosphate and other modifications are introduced using the corresponding phosphoramidites. Synthesis of 3' GalNAc conjugated single strands was performed on a GalNAc modified CPG support. Custom CPG universal solid support was used for the synthesis of antisense single strands. Coupling time for all phosphoramidites (100 mM in acetonitrile) is 5 min employing 5-Ethylthio-1H-tetrazole (ETT) as activator (0.6 M in acetonitrile). Phosphorothioate linkages were generated using a 50 mM solution of 3-((Dimethylamino-methylidene) amino)-3H-1,2,4-dithiazole-3-thione (DDTT, obtained from Chemgenes (Wilmington, Mass., USA)) in anhydrous acetonitrile/pyridine (1:1 v/v). Oxidation time was 3 minutes. All sequences were synthesized with final removal of the DMT group ("DMT off").

Upon completion of the solid phase synthesis, oligoribonucleotides were cleaved from the solid support and deprotected in sealed 96 deep well plates using 200 µL Aqueous Methylamine reagents at 60° C. for 20 minutes. For sequences containing 2' ribo residues (2'-OH) that are protected with a tert-butyl dimethyl silyl (TBDMS) group, a second step deprotection is performed using TEA.3HF (triethylamine trihydro fluoride) reagent. To the methylamine deprotection solution, 200 uL of dimethyl sulfoxide (DMSO) and 300 ul TEA.3HF reagent were added and the solution was incubated for additional 20 min at 60° C. At the end of cleavage and deprotection step, the synthesis plate was allowed to come to room temperature and is precipitated by addition of 1 mL of acetontile:ethanol mixture (9:1). The plates are cooled at −80 C for 2 hours, superanatant was decanted carefully with the aid of a multi channel pipette. The oligonucleotide pellet was re-suspended in 20 mM NaOAc buffer and is desalted using a 5 mL HiTrap size exclusion column (GE Healthcare) on an AKTA Purifier System equipped with an A905 autosampler and a Frac 950 fraction collector. Desalted samples are collected in 96-well plates. Samples from each sequence were analyzed by LC-MS to confirm the identity, UV (260 nm) for quantification and a selected set of samples by IEX chromatography to determine purity.

Annealing of single strands was performed on a Tecan liquid handling robot. Equimolar mixture of sense and antisense single strands were combined and annealed in 96 well plates. After combining the complementary single strands, the 96-well plate was sealed tightly and heated in an oven at 100° C. for 10 minutes and allowed to come slowly to room temperature over a period 2-3 hours. The concentration of each duplex was normalized to 1004 in 1×PBS.

Example 2-In Vitro Screening

Cell Culture and Transfections

Hep3B (ATCC) were transfected by adding 4.9 µl of Opti-MEM plus 0.1 µl of Lipofectamine RNAiMax per well (Invitrogen, Carlsbad Calif. cat #13778-150) to 5 µl of siRNA duplexes per well into a 384-well plate and incubated at room temperature for 15 minutes. Fifty µl of DMEM containing ~5×10$^3$ cells were then added to the siRNA mixture. Cells were incubated for 24 hours prior to RNA purification. Single dose experiments were performed at 10 nM and 0.1 nM and in some cases 1 nM final duplex concentration.

Total RNA Isolation Using DYNABEADS mRNA Isolation Kit

RNA was isolated using an automated protocol on a BioTek-EL406 platform using DYNABEADs (Invitrogen, cat #61012). Briefly, 50 µl of Lysis/Binding Buffer and 25 µl of lysis buffer containing 3 µl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 µl Wash Buffer A and once with Wash Buffer B. Beads were then washed with 150 µl Elution Buffer, re-captured and supernatant removed.

cDNA Synthesis Using ABI High Capacity cDNA Reverse Transcription Kit (Applied Biosystems, Foster City, Calif., Cat #4368813)

Ten µl of a master mix containing 1 µl 10× Buffer, 0.4 µl 25×dNTPs, 1 µl 10× Random primers, 0.5 µl Reverse Transcriptase, 0.5 µl RNase inhibitor and 6.6 µl of H$_2$O per reaction was added to RNA isolated above. Plates were sealed, mixed, and incubated on an electromagnetic shaker for 10 minutes at room temperature, followed by 2 hours 37° C. Plates were then incubated at 81° C. for 8 minutes.

Real Time PCR

Two µl of cDNA were added to a master mix containing 0.5 µl of GAPDH TaqMan Probe (Hs99999905 m1), 0.5 µl IGFALS probe (HS00744047 S1) and 5 µl Lightcycler 480 probe master mix (Roche Cat #04887301001) per well in a 384 well plates (Roche cat #04887301001). Real time PCR was done in a LightCycler480 Real Time PCR system (Roche). Each duplex was tested at least two times and data were normalized to naïve cells or cells transfected with a non-targeting control siRNA.

To calculate relative fold change, real time data were analyzed using the ΔΔCt method and normalized to assays performed with cells transfected with 10 nM AD-1955, or mock transfected cells.

TABLE 2

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| A | Adenosine-3'-phosphate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide (G, A, C, T or U) |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol-Hyp-(GalNAcalkyl)3 |
| dT | 2'-deoxythymidine-3'-phosphate |
| dC | 2'-deoxycytidine-3'-phosphate |
| Y44 | inverted abasic DNA (2-hydroxymethyl-tetrahydrofurane-5-phosphate) |
| (Tgn) | Thymidine-glycol nucleic acid (GNA) S-Isomer |
| P | Phosphate |
| VP | Vinyl-phosphate |
| (Aam) | 2'-O-(N-methylacetamide)adenosine-3'-phosphate |

TABLE 3

Unmodified Sense and Antisense Strand Sequences of IGFALS dsRNAs

| Duplex name | Sense name | Sense Sequence | Position in NM_004970.2 | SEQ ID NO | Antisense name | Antisense Sequence | Position in NM_004970.2 | SEQ ID NO |
|---|---|---|---|---|---|---|---|---|
| AD-62728 | A-125826 | ACAGAUGAGCUCAGCUCUUU | 196-216 | 28 | A-125827 | AAAGACCUGAGCUCAUCUGUGU | 194-216 | 85 |
| AD-62741 | A-125832 | AGCUCAGCGUCUUUUGCAGUU | 203-223 | 29 | A-125833 | AACUGCAAAAGACGCUGAGCUCA | 201-223 | 86 |
| AD-68729 | A-138233 | CUGUGGCUGACGGCAACAAA | 318-337 C21A | 30 | A-138234 | UUUGUUGCCGUCCAGCCACAGGG | 316-337 C21A | 87 |
| AD-68720 | A-138215 | GGACGGCAACAACCUCUCGUA | 326-345 C21A | 31 | A-138216 | UACGAGAGGUUGUUGCCGUCCAG | 324-345 C21A | 88 |
| AD-68717 | A-138209 | AACCGUCUGAGCAGGCUGGAA | 549-568 G21A | 32 | A-138210 | UUCCAGCCUGCUCAGACCGUUGU | 547-568 G21A | 89 |
| AD-62737 | A-125830 | GGACCUCAACCUGGGUUGGAA | 558-578 | 33 | A-125831 | UUCCAACCCAGGUUGAGGUCCCA | 556-578 | 90 |
| AD-62713 | A-125820 | UGGCAACAAACUGACUUACCU | 645-665 | 34 | A-125821 | AGGUAAGUCAGUUUGUUGCCAGC | 643-665 | 91 |
| AD-62742 | A-125786 | GGUGCUGGCGGCAACAGGCU | 678-698 | 35 | A-125787 | AGCCUGUUGCCCGCCAGCACCAG | 676-698 | 92 |
| AD-62719 | A-125838 | GCUGGACCUGAGCAGGAACGA | 747-767 C21A | 36 | A-125839 | UCGUUCCUGCUCAGGUCCAGCUC | 745-767 C21A | 93 |
| AD-62724 | A-125840 | CUGGACCUGAGCAGGAACGCA | 748-768 G21A | 37 | A-125841 | UGCGUUCCUGCUCAGGUCCAGCU | 746-768 G21A | 94 |
| AD-68728 | A-138231 | GGCCAUCAAGGCAAACGUGUU | 776-795 | 38 | A-138232 | AACACGUUUGCCUUGAUGGCCCG | 774-795 | 95 |
| AD-62717 | A-125806 | GCAACCUCAUGCUGCCGUGA | 833-853 G21A | 39 | A-125807 | UCACGGCAGCGAUGAGGUUGCGG | 831-853 G21A | 96 |
| AD-62731 | A-125796 | GCUGCCCGGGCCCCGGCGCA | 844-864 C21A | 40 | A-125797 | UGCGCCGGGGCCCGGGCAGCGA | 842-864 C21A | 97 |
| AD-62726 | A-125794 | UGGCCCCGGGCGCCUUCCUGA | 851-871 G21A | 41 | A-125795 | UCAGGAAGGCGCCCGGGGCCACG | 849-871 G21A | 98 |
| AD-68727 | A-138229 | GGGCCUGAAGGCGCUGCGAUA | 872-891 G21A | 42 | A-138230 | UAUCGCAGCGCCUUCAGGCCCAG | 870-891 G21A | 99 |
| AD-62715 | A-125774 | GCGUGGCUGGCCUCCUGGAGA | 911-931 G21A | 43 | A-125775 | UCUCCAGGAGGCCAGCCACGCGG | 909-931 G21A | 100 |
| AD-68710 | A-138195 | GGCCUCCUGGAGGACACGUUA | 921-940 C21A | 44 | A-138196 | UAACGUGUCCUCCAGGAGGCCAG | 919-940 C21A | 101 |
| AD-62743 | A-125802 | UGGGCCACAACCGCAUCCGGA | 1043-1063 C21A | 45 | A-125803 | UCCGGAUGCGGUUGUGGCCCAGC | 1041-1063 C21A | 102 |
| AD-62711 | A-125788 | CCACAACCGCAUCCGGCAGCU | 1047-1067 | 46 | A-125789 | AGCUGCCGGAUGCGGUUGUGGCC | 1045-1067 | 103 |
| AD-68709 | A-138193 | AGCUGGCUGAGCGCCAGCUUA | 1066-1085 G21A | 47 | A-138194 | UAAAGCUGGCGCUCAGCCAGCUGC | 1064-1085 G21A | 104 |
| AD-68724 | A-138223 | CUCACGCUAGACCACACCAA | 1110-1129 G21A | 48 | A-138224 | UUGGUUGGUCUAGCGUGAGCA | 1108-1129 G21A | 105 |
| AD-62734 | A-125782 | CCUCACCAACGUGGCGUCAU | 1161-1181 | 49 | A-125783 | AUGACCGCCACGUUGGUGAGGCC | 1159-1181 | 106 |
| AD-68111 | A-135415 | CCUCACCAACGUGGCGUCAU | 1161-1181 | 50 | A-135416 | AUGACCGCCACGUUGGUGAGGCC | 1159-1181 | 107 |

TABLE 3-continued

Unmodified Sense and Antisense Strand Sequences of IGFALS dsRNAs

| Duplex name | Sense name | Sense Sequence | Position in NM_004970.2 | | SEQ ID NO | Antisense name | Antisense Sequence | Position in NM_004970.2 | | SEQ ID NO |
|---|---|---|---|---|---|---|---|---|---|---|
| AD-68719 | A-138213 | CACCAACGUGGCGGUCAUGAA | 1166-1185 | | 51 | A-138214 | UUCAUGACCGCCACGUUGGUGAG | 1164-1185 | | 108 |
| AD-68712 | A-138199 | ACCAACGUGGCGGUCAUGAAA | 1167-1186 | C21A | 52 | A-138200 | UUUCAUGACCGCCACGUUGGUGA | 1165-1186 | C21A | 109 |
| AD-62730 | A-125780 | UCAUGAACCUCUCUGGGAACU | 1178-1198 | | 53 | A-125781 | AGUUCCCAGAGAGGUUCAUGACC | 1176-1198 | | 110 |
| AD-68711 | A-138197 | ACCUCUCUGGGAACUGUCUCA | 1186-1205 | C21A | 54 | A-138198 | UGAGACAGUUCCCAGAGAGGUUC | 1184-1205 | C21A | 111 |
| AD-68713 | A-138201 | CUCUCUGGGAACUGUCUCCGA | 1188-1207 | G21A | 55 | A-138202 | UCCGGAGACAGUUCCCAGAGAGGU | 1186-1207 | G21A | 112 |
| AD-62732 | A-125812 | GAACUGUCUCCGGAACCUUCA | 1194-1214 | C21A | 56 | A-125813 | UGAAGGUUCCGGAGACAGUUCCC | 1192-1214 | C21A | 113 |
| AD-68715 | A-138205 | GGAACUGUCUCCGGAACCUUA | 1195-1214 | C21A | 57 | A-138206 | UAAGGUUCCGGAGACAGUUCCCA | 1193-1214 | C21A | 114 |
| AD-62738 | A-125784 | CUGUCUCCGGAACCUUCCGGA | 1197-1217 | | 58 | A-125785 | UCCGGAAGGUUCCGGAGACAGUU | 1195-1217 | | 115 |
| AD-62736 | A-125814 | GUCUCCGGAACCUUCCGGAGA | 1199-1219 | C21A | 59 | A-125815 | UCUCCGGAAGGUUCCGGAGACAG | 1197-1219 | C21A | 116 |
| AD-62712 | A-125804 | CGGAACCUUCCGGAGCAGGUA | 1204-1224 | G21A | 60 | A-125805 | UACCUGCUCCGGAAGGUUCCGGA | 1202-1224 | G21A | 117 |
| AD-68723 | A-138221 | AACCUUCCGGAGCAGGUGUUA | 1209-1228 | C21A | 61 | A-138222 | UAACACCUGCUCCGGAAGGUUCC | 1207-1228 | C21A | 118 |
| AD-62739 | A-125800 | CUUCCGAGCAGGUGUUCCGA | 1210-1230 | G21A | 62 | A-125801 | UCGGAACACCUGCUCCGAAGGU | 1208-1230 | G21A | 119 |
| AD-62723 | A-125824 | CAUCCAGCAUCGAAGAACA | 1302-1322 | | 63 | A-125825 | UGUUCUUCGAUGCUGGAGAUGCU | 1300-1322 | | 120 |
| AD-62745 | A-125834 | CUCCAGCAUCGAAGAACAGAA | 1305-1325 | G21A | 64 | A-125835 | UUCUGUUCUUCGAUGCUGGAGAU | 1303-1325 | G21A | 121 |
| AD-62733 | A-125828 | CAGCAUCGAAGAACAGAGCCU | 1308-1328 | | 65 | A-125829 | AGGCUCUGUUCUUCGAUGCUGGA | 1306-1328 | | 122 |
| AD-68718 | A-138211 | UUCCUCAAGGACAACCGCCUA | 1329-1348 | C21A | 66 | A-138212 | UAGGCCGUUGUCCUUGAGGAAGA | 1327-1348 | C21A | 123 |
| AD-62744 | A-125818 | AAGGACAACGGCCUCGUGGGA | 1333-1353 | C21A | 67 | A-125819 | UCCCACGAGGCCGUUGUCCUUGA | 1331-1353 | C21A | 124 |
| AD-68721 | A-138217 | GCUGCUGGAGCUCGACCUGAA | 1388-1407 | C21A | 68 | A-138218 | UUCAGGUCGAGCUCCAGCAGCUC | 1386-1407 | C21A | 125 |
| AD-62727 | A-125810 | UGACCUCCAACCAGCUCACGA | 1403-1423 | C21A | 69 | A-125811 | UCGUGAGCUGGUUGGAGGUCAGG | 1401-1423 | C21A | 126 |
| AD-62740 | A-125816 | CAACCAGCUCACGCACCUGCA | 1410-1430 | C21A | 70 | A-125817 | UGCAGGUGCGUGAGCUGGUUGGA | 1408-1430 | C21A | 127 |
| AD-62716 | A-125790 | UGGAGUACCUGCUGCUCUCCA | 1460-1480 | C21A | 71 | A-125791 | UGGAGAGCAGCAGGUACUCCAGC | 1458-1480 | C21A | 128 |
| AD-62725 | A-125778 | UGCAGCGGGCCUUCUGGCUGA | 1523-1543 | G21A | 72 | A-125779 | UCAGCCAGAAGGCCCGCUGCAGG | 1521-1543 | G21A | 129 |
| AD-62714 | A-125836 | GCAGCGGGCCUUCUGGCUGGA | 1524-1544 | | 73 | A-125837 | UCCAGCCAGAAGGCCCGCUGCAG | 1522-1544 | | 130 |

TABLE 3-continued

Unmodified Sense and Antisense Strand Sequences of IGFALS dsRNAs

| Duplex name | Sense name | Sense Sequence | Position in NM_004970.2 | SEQ ID NO | Antisense name | Antisense Sequence | Position in NM_004970.2 | SEQ ID NO |
|---|---|---|---|---|---|---|---|---|
| AD-68716 | A-138207 | UUCUGGCUGGACGUCUCGCAA | 1536-1555 C21A | 74 | A-138208 | UUGCGAGACGUCCAGCCAGAAGG | 1534-1555 C21A | 131 |
| AD-62721 | A-125792 | GGCUGGACGUCUCGCACAACA | 1538-1558 C21A | 75 | A-125793 | UGUUGUGCGAGACGUCCAGCCAG | 1536-1558 C21A | 132 |
| AD-62718 | A-125822 | UCAGGAAUAACUCCUUGCAGA | 1577-1597 | 76 | A-125823 | UCUGCAAGGAGUUAUUCCUGAGG | 1575-1597 | 133 |
| AD-68722 | A-138219 | UCAGCCUCAGGAACAACUCAA | 1615-1634 C21A | 77 | A-138220 | UUGAGUUGUUCCUGAGGCUGAGG | 1613-1634 C21A | 134 |
| AD-68725 | A-138225 | CAGCCUCAGGAACAACUCACU | 1616-1635 | 78 | A-138226 | AGUGAGUUGUUCCUGAGGCUGAG | 1614-1635 | 135 |
| AD-68714 | A-138203 | AGCCUCAGGAACAACUCACUA | 1617-1636 G21A | 79 | A-138204 | UAGUGAGUUGUUCCUGAGGCUGA | 1615-1636 G21A | 136 |
| AD-62722 | A-125808 | UCCAGGCCAUCUGUGAGGGGA | 1766-1786 G21A | 80 | A-125809 | UCCCCUCACAGAUGGCCUGGACG | 1764-1786 G21A | 137 |
| AD-62735 | A-125798 | GGGGACCAGGUCCUCAGUGUCA | 1956-1976 C21A | 81 | A-125799 | UGACACUGAGGACCUGUCCCCAG | 1954-1976 C21A | 138 |
| AD-68731 | A-138237 | UGUCAUCAAUUAAAGGCAAAA | 2054-2073 G21A | 82 | A-138238 | UUUUGCCUUUAAUUGAUGACAGC | 2052-2073 G21A | 139 |
| AD-68730 | A-138235 | UCAAUUAAAGGCAAAGGCAAU | 2059-2078 | 83 | A-138236 | AUUGCCUUUGCCUUUAAUUGAUG | 2057-2078 | 140 |
| AD-68726 | A-138227 | AAAGGCAAAGGCAAUCGAAUA | 2065-2084 C21A | 84 | A-138228 | UAUUCGAUUGCCUUUGCCUUUAA | 2063-2084 C21A | 141 |

TABLE 4

IGFALS Single Dose Screen in Hep3B Cells

| DuplexID | Hep3B 10 nM Avg | 10 nM SD | 1 nM Avg | 1 nM SD | 0.1 nM Avg | 0.1 nM SD |
|---|---|---|---|---|---|---|
| AD-68729 | 53.9 | 16.0 | 57.5 | 3.8 | 97.4 | 7.0 |
| AD-68720 | 48.4 | 4.1 | 73.2 | 27.9 | 116.3 | 9.3 |
| AD-68717 | 22.6 | 5.6 | 55.4 | 8.3 | 101.8 | 26.9 |
| AD-62742 | 126.5 | 20.7 | ND | | 124.7 | 13.1 |
| AD-62719 | 106.8 | 25.1 | ND | | 66.5 | 4.7 |
| AD-62724 | 87.8 | 8.4 | ND | | 75.1 | 5.7 |
| AD-68728 | 56.3 | 7.6 | 78.6 | 4.4 | 110.6 | 26.0 |
| AD-62717 | 98.6 | 1.7 | ND | | 102.9 | 56.2 |
| AD-62731 | 105.7 | 3.4 | ND | | 51.1 | 18.3 |
| AD-62726 | 70.7 | 37.7 | ND | | 93.5 | 8.9 |
| AD-68727 | 68.9 | 14.6 | 94.8 | 12.8 | 124.7 | 23.3 |
| AD-62715 | 118.5 | 41.8 | ND | | 128.4 | 17.9 |
| AD-68710 | 91.0 | 34.2 | 91.7 | 14.2 | 90.5 | 1.1 |
| AD-62743 | 81.6 | 18.1 | ND | | 123.9 | 20.9 |
| AD-62711 | 107.0 | 11.3 | ND | | 92.0 | 11.5 |
| AD-68709 | 42.4 | 2.2 | 38.1 | 1.4 | 76.1 | 1.4 |
| AD-68724 | 53.5 | 16.7 | 40.9 | 7.9 | 73.8 | 1.2 |
| AD-62734 | 43.1 | 29.6 | ND | | 115.2 | 0.3 |
| AD-68111 | 29.5 | 14.8 | 37.5 | 0.7 | 92.1 | 3.9 |
| AD-68719 | 45.4 | 18.9 | 59.6 | 5.7 | 108.7 | 25.0 |
| AD-68712 | 40.8 | 1.9 | 58.0 | 4.7 | 97.4 | 13.1 |
| AD-62730 | 98.4 | 14.2 | ND | | 119.5 | 17.2 |
| AD-68711 | 97.3 | 23.0 | 86.6 | 5.7 | 110.7 | 14.8 |
| AD-68713 | 79.6 | 10.0 | 93.6 | 23.9 | 103.3 | 4.2 |
| AD-62732 | 89.0 | 13.3 | ND | | 66.0 | 14.3 |
| AD-68715 | 48.7 | 13.1 | 71.9 | 6.8 | 78.7 | 7.2 |
| AD-62738 | 133.2 | 34.5 | ND | | 123.4 | 13.0 |
| AD-62736 | 113.6 | 22.9 | ND | | 84.9 | 13.9 |
| AD-62712 | 68.5 | 22.6 | ND | | 96.9 | 25.6 |
| AD-68723 | 83.3 | 14.5 | 84.4 | 13.8 | 71.8 | 25.4 |
| AD-62739 | 99.4 | 13.8 | ND | | 105.6 | 24.4 |
| AD-68718 | 83.1 | 6.8 | 78.2 | 0.1 | 119.8 | 36.8 |
| AD-62744 | 98.8 | 10.4 | ND | | 139.1 | 24.7 |
| AD-68721 | 61.8 | 8.0 | 81.3 | 4.2 | 99.2 | 14.2 |
| AD-62727 | 91.6 | 25.9 | ND | | 86.6 | 46.5 |
| AD-62740 | 138.9 | 16.0 | ND | | 117.3 | 55.5 |
| AD-62716 | 81.5 | 0.2 | ND | | 127.8 | 20.9 |
| AD-62725 | 109.1 | 6.1 | ND | | 103.8 | 17.0 |
| AD-62714 | 73.9 | 8.9 | ND | | 64.0 | 16.0 |
| AD-68716 | 18.2 | 0.3 | 28.6 | 17.6 | 40.2 | 10.8 |
| AD-62721 | 62.0 | 7.7 | ND | | 91.7 | 6.1 |
| AD-68722 | 19.2 | 0.5 | 51.1 | 0.7 | 53.4 | 22.2 |
| AD-68725 | 20.3 | 7.5 | 23.0 | 6.2 | 67.6 | 15.6 |
| AD-68714 | 58.9 | 2.8 | 73.5 | 19.0 | 92.6 | 8.9 |
| AD-62722 | 120.7 | 69.9 | ND | | 115.0 | 25.4 |
| AD-62735 | 60.2 | 29.8 | ND | | 100.2 | 22.6 |
| AD-68731 | 33.5 | 27.2 | 11.8 | 0.9 | 26.6 | 7.4 |
| AD-68730 | 14.5 | 0.9 | 24.5 | 7.5 | 44.4 | 8.3 |
| AD-68726 | 17.0 | 10.0 | 28.6 | 11.8 | 64.5 | 3.7 |
| AD-62728 | 46.3 | 20.5 | ND | | 49.5 | 10.2 |
| AD-62741 | 116.8 | 48.6 | ND | | 143.6 | 35.9 |
| AD-62737 | 94.7 | 8.6 | ND | | 75.2 | 55.1 |
| AD-62713 | 83.0 | 20.3 | ND | | 89.3 | 31.9 |
| AD-62723 | 103.5 | 32.2 | ND | | 66.5 | 22.2 |
| AD-62745 | 66.7 | 4.4 | ND | | 85.7 | 61.2 |
| AD-62733 | 107.1 | 1.3 | ND | | 35.9 | 3.8 |
| AD-62718 | 129.6 | 42.7 | ND | | 87.7 | 39.2 |
| AD-1955 | 102.5 | 25.0 | | | | |
| Mock | 103.0 | 18.8 | | | | |
| Naïve | 118.0 | 23.5 | | | | |

Data are expressed as percent message remaining relative to AD-1955 non-targeting control.

TABLE 5

| Duplex Name | Sense Oligo Name | Sense Sequence | Antisense Oligo Name | Antisense Sequence | SEQ ID NO | SEQ ID NO | Start Position in SEQ ID NO: 1 |
|---|---|---|---|---|---|---|---|
| AD-68729 | A-138233 | csusguggCfuGfGfAfcggcaacaaaL96 | A-138234 | usUfsuguUfgCfCfguccAfgCfcacagsgsg | 142 | 199 | 316 |
| AD-68720 | A-138215 | gsgsacggCfaAfCfAfaccucucguaL96 | A-138216 | usAfscgaCfaGfCfuuguUfgCfcguccsasg | 143 | 200 | 324 |
| AD-68717 | A-138209 | asasccguCfuGfAfGfcaggcuggaaL96 | A-138210 | usUfsccaGfcCfUfgcucAfgAfcgguusgsu | 144 | 201 | 547 |
| AD-62742 | A-125786 | GfsgsUfgCfuGfgCfGfGfCfaAfcAfgGfcUfL96 | A-125787 | asGfscCfuGfuUfgCfccgCfcAfgCfaCfcsasg | 145 | 202 | 676 |
| AD-62719 | A-125838 | GfscsUfgGfaCfcUfGfAfgCfaGfgAfaCfgAfL96 | A-125839 | usCfsgUfucUfcUfgCfucaGfgUfcCfaGfcsusc | 146 | 203 | 745 |
| AD-62724 | A-125840 | CfsusGfgAfcCfuGfAfGfcAfcGfgAfaAfcGfcAfL96 | A-125841 | usGfscGfuUfcCfuGfcucAfgGfucCfaAfgscsu | 147 | 204 | 746 |
| AD-68728 | A-138231 | gsgsccauCfaAfGfGfcaaacguguuL96 | A-138232 | asAfscacGfuUfUfgccuUfgAfuggccscsg | 148 | 205 | 774 |
| AD-62717 | A-125806 | GfscsAfaCfcUfcAfUfCfgCfuGfcCfcCfgAfL96 | A-125807 | usCfsaCfgGfcAfgGfgauGfaGfuUfgCfcsgsg | 149 | 206 | 831 |
| AD-62731 | A-125796 | GfscsUfgCfcGfuGfGfCfcCfcGfgGfcGfcAfL96 | A-125797 | usGfscGfcCfcGfgGfgccAfcGfcGfcAfcsgsa | 150 | 207 | 842 |
| AD-62726 | A-125794 | UfsgsGfcCfcCfcCfgGfGfGfcUfcUfcUfgAfL96 | A-125795 | usCfsaGfaGfaGfcCfgccCfgGfgGfcCfascsg | 151 | 208 | 849 |
| AD-62727 | A-138229 | gsgsgccuGfaAfGfGfcgcugcgauaL96 | A-138230 | usAfsucgCfaGfCfgccuUfcAfggcccsasg | 152 | 209 | 870 |
| AD-62715 | A-125774 | GfsGfuGfCfuGfCfuGfCfcUfGfcUfccUfgAfgAfL96 | A-125775 | usCfsuCfAfgGfaGfcaGfcAfcGfcsgsg | 153 | 210 | 909 |
| AD-68710 | A-138195 | gsgsccucCfuGfGfAfggaacguuaL96 | A-138196 | usAfsacgUfgUfCfcuccAfgGfaggccsasg | 154 | 211 | 919 |
| AD-62743 | A-125802 | UfsgsGfgCfcAfcAfAfCfcGfCfAfuCfcGfAfL96 | A-125803 | usCfsgcGfAfUfgGfguuGfCfcCfaCfCfaagsc | 155 | 212 | 1041 |
| AD-62711 | A-125788 | CfsscAfcAfcCfgAfCfGfAfuCfcGfcAfgCfL96 | A-125789 | asGfscUfgCfGfaUfgeGfUfuGfugGfscsc | 156 | 213 | 1045 |
| AD-68709 | A-138193 | asgscuggCfuGfAfGfcgcagcuuuaL96 | A-138194 | usAfsaagCfuGfCfgcucAfgCfcagcusgsc | 157 | 214 | 1064 |
| AD-68724 | A-138223 | csuscacgCfuAfGfGfAfcccaaccaaL96 | A-138224 | usUfsgguUfgGfGfgucuAfgCfgugagscsa | 158 | 215 | 1108 |
| AD-62734 | A-125782 | CfsscsUfcAfcCfaAfCfGfgUfGfgCfGfuCfaUfL96 | A-125783 | asUfsgAfcCfGfcCfAfcguUfgGfuGfaGfgcsc | 159 | 216 | 1159 |
| AD-68111 | A-135415 | csscsucaCfaAfCfGfugegguucauL96 | A-135416 | asUfsgacCfgCfCfacguUfgGfagguysasg | 160 | 217 | 1159 |
| AD-68719 | A-138213 | csasccaaCfgUfGfGfcggucaugaaL96 | A-138214 | usUfscauGfaCfCfgccAfcGfuuggusgsa | 161 | 218 | 1164 |
| AD-68712 | A-138199 | ascscaacGfuGfGfCfgguucaugaaL96 | A-138200 | usUfscauGfaCfcGfccAfcGfuuggusgsa | 162 | 219 | 1165 |
| AD-62730 | A-125780 | UfscsAfuGfAfcCfCfUfcUfgGfgGfaAfcUfL96 | A-125781 | asGfsuUfcCfcAfgAfgagGffUfcAfuGfascsc | 163 | 220 | 1176 |
| AD-68711 | A-138197 | ascsucucUfgGfGfaacuguacaL96 | A-138198 | usGfsagacCfaGfUfcucccAfgaggusysc | 164 | 221 | 1184 |

TABLE 5-continued

Modified Sequences

| Duplex Name | Sense Oligo Name | Sense Sequence | SEQ ID NO | Antisense Oligo Name | Antisense Sequence | SEQ ID NO | Start Position in SEQ ID NO: 1 |
|---|---|---|---|---|---|---|---|
| AD-68713 | A-138201 | csuscucuGfgGfAfAfcugucccgaL96 | 165 | A-138202 | usCfsggaGfacTfAfguucCfcAfgagagsgsu | 222 | 1186 |
| AD-62732 | A-125812 | GfsasAfcUfgUfcCfcCfuGfcUfCfcGfaAfcCfuUTCfaFL96 | 166 | A-125813 | usGfsaaAfgGfuUfcCfggaGfacGfaGfuUfcscsc | 223 | 1192 |
| AD-68715 | A-138205 | gsgsaacuGfucUfcCfcggaaccuaL96 | 167 | A-138206 | usAfsaggUfucCfCfggagAfcAfguuccscsa | 224 | 1193 |
| AD-62738 | A-125784 | CfsusGfucUfcCfcGfGfAfAfcCfcUfucCfcGfGfaFL96 | 168 | A-125785 | usCfscGfaAfaGfgUfuccGfgAfgAfcAfgsusu | 225 | 1195 |
| AD-62736 | A-125814 | GfsusCfucCfcGfgAfAfCfcUfutCfcGfgAfgAfL96 | 169 | A-125815 | usCfsuUfccGfgAfaGfguuCfcGfgAfgAfcsasg | 226 | 1197 |
| AD-62712 | A-125804 | CfsggGfaAfcCfuUfCfcGfcAfgGfuUfcCfgGfAfL96 | 170 | A-125805 | usAfscCfcuGfcUfcCfcGgaAfgGfuUfcCfgsgsa | 227 | 1202 |
| AD-68723 | A-138221 | asascuuCfcGfGfAfgcagguguaL96 | 171 | A-138222 | usAfsacaCfcUfGfcuccCfgAfagguuscsc | 228 | 1207 |
| AD-62739 | A-125800 | CfsusUfcCfgGfaGfCfAfgGfuUfcCfgAfL96 | 172 | A-125801 | usCfsgGfaAfcAfcCfugcUfcCfgGfaAfgsgsu | 229 | 1208 |
| AD-68718 | A-138211 | ususcucAfaGfGfAfcaacggccuaL96 | 173 | A-138212 | usAfsggcCfgUfUfguccUfuGfaggaasgsa | 230 | 1327 |
| AD-62744 | A-125818 | AfsaGfgAfcAfcAfCfGfGfCfucGfgGfcAfL96 | 174 | A-125819 | usCfscCftaCfgAfgCfGfagcuCfaAfcagcsusc | 231 | 1331 |
| AD-62721 | A-138217 | gscsugcuGfgAfGfCfucgaccugaaL96 | 175 | A-138218 | usGfscaGfgucCfgAgcuCfaAfgcaguUfsga | 232 | 1386 |
| AD-62727 | A-125810 | UfsgsAfccCftucCfAfAfCfcCfucCftaCfgAfL96 | 176 | A-125811 | usCfsgUfgAfgCfCfuGfguuGfgAfgCfuCfasgsg | 233 | 1401 |
| AD-62740 | A-125816 | CfsasAfcCfaGfcUfCfAfcGfcAfcCfuGfcAfL96 | 177 | A-125817 | usGfscAfggGfaGfGfcGfugaGfcUfgGfuUfgssa | 234 | 1408 |
| AD-62716 | A-125790 | UfsgsGfaAfcGfcGfgCfCfCfuUfcCfuUfcCfAfL96 | 178 | A-125791 | usGfsGfaAfgGfgCfgCfcaggGfuAfcUfcCfasgsc | 235 | 1458 |
| AD-62725 | A-125778 | UfsgsCfaGfcCfaGfcCfCfCfdacUfgGfcUfgGfL96 | 179 | A-125779 | usCfsaGfcCfaGfcAfAfgcAfaggCfcCfcuCfgCfasgsg | 236 | 1521 |
| AD-62714 | A-125836 | GfscsAfgCfuGfgCfGfCfuFfuCfuGfgCfuGfgaL96 | 180 | A-125837 | usCfscAfgcCfcAfgAfagCfcCfcuGfcCfgCfcasg | 237 | 1522 |
| AD-68716 | A-138207 | ususcuggCfuGfGfAfcgucucguaL96 | 181 | A-138208 | usGfsgcGfafgAfCfguccAfgCfcagasasgsg | 238 | 1534 |
| AD-62721 | A-125792 | GfsgsCfugGfagCfGfCfufCfcUfcaCfaAfcafL96 | 182 | A-125793 | usGfsuUfgUfgCfgAfgacGfuCfcAfgCfcasg | 239 | 1536 |
| AD-68722 | A-138219 | uscsagcUfcAfGfGfaacaacucaL96 | 183 | A-138220 | usUfsgagGfuGfUfuuccuGfaGfgcugasgsg | 240 | 1613 |
| AD-68725 | A-138225 | csasagccuCfaGfGfAfacaacucacuL96 | 184 | A-138226 | asGfsugaGfuUfGfuuccUfgAfggcugsasg | 241 | 1614 |
| AD-68714 | A-138203 | asgsccucAfgGfAfAfcaacucacuaL96 | 185 | A-138204 | usAfsguAfgUfUfguccCfuGfaggcusgsa | 242 | 1615 |
| AD-62722 | A-125808 | UfscscsCfaGfcGfcAfUfCfcAfUfcUfuGfGfgAfL96 | 186 | A-125809 | usCfscCfcUfcAfcAfgauGfcCfcUfgGfascsg | 243 | 1764 |
| AD-62735 | A-125798 | GfsgsGfgAfcAfgGfUfCfcAfgGfuCfCfcAfL96 | 187 | A-125799 | usGfsaCfacCfuGfaGfgaccCfuGfucCfcCfcasg | 244 | 1954 |

TABLE 5-continued

Modified Sequences

| Duplex Name | Sense Oligo Name | Sense Sequence | SEQ ID NO | Antisense Oligo Name | Antisense Sequence | SEQ ID NO | Start Position in SEQ ID NO: 1 |
|---|---|---|---|---|---|---|---|
| AD-68731 | A-138237 | usgsucauCfaAfUfUfaaaggcaaaaL96 | 188 | A-138238 | usUfsuugCfcUfUfuaauUfgAfugacasgsc | 245 | 2052 |
| AD-68730 | A-138235 | uscsaauuAfaAfGfGfcaaaggcaauL96 | 189 | A-138236 | asUfsugcCfuUfUfgccuUfuAfauugasusg | 246 | 2057 |
| AD-68726 | A-138227 | asasaggcAfaAfGfGfcaaucgauauaL96 | 190 | A-138228 | usAfsuucGfaUfUfgccuUfuGfccuuusasa | 247 | 2063 |
| AD-62728 | A-125826 | AfscsAfgAfuGfaGfcGfUfcAfgCfgUfcUTuUfL96 | 191 | A-125827 | asAfsaGfaCfgCfuGfagcUfcAfuCfuGfusgsu | 248 | 774 |
| AD-62741 | A-125832 | AfsgsCfuCfaGfcGfUfCfuUfUfgCfaGfuUfL96 | 192 | A-125833 | asAfscUfgCfaAfaAfgacGfuGfAfgCfuscsa | 249 | 201 |
| AD-62737 | A-125830 | GfsgsAfcCfuCfaAfaAfCfuGfaCfuUfaCfcUfL96 | 193 | A-125831 | usUfscCfaAfcCfcAfgguUfgAfgGfuCfcscsa | 250 | 556 |
| AD-62713 | A-125820 | UfsgsGfcAfaCfaAfaAfCfuGfacUfuUfaCfcUfL96 | 194 | A-125821 | asGfsgUfaAfgUfcAfguuUfgUfuGfcCfasgsc | 251 | 643 |
| AD-62723 | A-125824 | CfsasUfcUfccAfgCfcAfaUfcGfaAfaGfaAfcAfL96 | 195 | A-125825 | usGfsuUfcUfucUfgAfugcUfgGfaGfaUfgscsu | 252 | 1300 |
| AD-62745 | A-125834 | CfsusCfcAfgCfaUfcGfaAfgAfaAfcAfgAfaAfL96 | 196 | A-125835 | usUfscUfgUfuCfuUfcgaUfcGfuGfAfgsasu | 253 | 1301 |
| AD-62733 | A-125828 | CfsasGfcAfuCfgAfaGfaAfcAfgAfgCfcUfL96 | 197 | A-125829 | asGfsgCfuCfuGfuUfcuuCfgAfuGfcUfgsgsa | 254 | 1306 |
| AD-62718 | A-125822 | UfscsAfgGfaAfuAfaCfuCfcUfuGfcAfgAfL96 | 198 | A-125823 | usCfsuGfcAfaGfaAfguuAfuUfcCfuGfasgsg | 255 | 1575 |

Example 3-Knockdown of IGFALs Expression with an IGFALS siRNA Decreases Expression of IGF-1

A series of siRNAs targeting mouse IGFALS were designed and tested for the ability to knockdown expression of IGFALs mRNA in 6-8 week old C57Bl/6 female mice (n=3 per group). A single 10 mg/kg dose of AD-62713, AD-62724, AD-62745, or AD-62728; or PBS control, was administered subcutaneously on day 1. On day 7, the mice were sacrificed to assess knockdown of IGFLALS mRNA in liver and IGFALS and IGF-1 protein in serum.

AD-62728 was found to be most effective in decreasing expression of IGFALS mRNA and protein. Specifically, at day 7, IFGALS mRNA expression in the liver was found to be about 15% of the PBS control. At day 7 after treatment with AD-62713 and AD-62745, IGFALS mRNA expression in the liver was found to be about 65% of the PBS control for both duplexes.

A decrease in serum IGFALS protein levels was found to correspond to the decrease in IGFALS mRNA in the liver. Specifically, AD-62728 decreased the serum IGFALS protein level to about 3.9 µg/ml, as compared to about 6.4 µg/ml in the PBS control. AD-62713 and AD-62745 decreased the serum IGFALS level to about 5.2 µg/ml and 4.6 µg/ml, respectively.

A decrease in serum IGF-1 was also observed in response to treatment with the duplexes. Specifically, AD-62727 decreased the serum IGF-1 protein level to about 13 ng/ml as compared to about 34 ng/ml in the PBS control. AD-62713 and AD-62745 decreased serum IGF-1 levels to about 20 ng/ml and 27 ng/ml, respectively.

Further, in a multidose study, AD-62728 was demonstrated to be effective in knockdown of expression of IGFALS mRNA in liver in an expected dose response manner. Specifically, C57Bl/6 female mice, 6-8 weeks of age (n=3 per group) were administered either four doses of AD-62728 at 1 mg/kg or 3 mg/kg once weekly, or two doses at 3 mg/kg or 10 mg/kg every other week; or a PBS control. IGFALS mRNA knockdown was observed in the expected dose response manner.

Example 4-In Vitro Screening

Bioinformatics

A set of double stranded RNAi agents targeting human IGFALS (human NCBI ref seq ID: NM_004970; NCBI GeneID: 3483, SEQ ID NO: 1) were designed using custom R and Python scripts. The human IGFALS REFSEQ mRNA has a length of 2168 bases.

The rationale and method for the set of agent designs is as follows: the predicted efficacy for every potential 19mer siRNA from position 10 through position 2168 was determined with a linear model derived the direct measure of mRNA knockdown from more than 20,000 distinct siRNA designs targeting a large number of vertebrate genes. The custom Python script built the set of agents by systematically selecting a siRNA every 11 bases along the target mRNA starting at position 10. At each of the positions, the neighboring agent (one position to the 5' end of the mRNA, one position to the 3' end of the mRNA) was swapped into the design set if the predicted efficacy was better than the efficacy at the exact every-11th siRNA. Low complexity agents, i.e., those with Shannon Entropy measures below 1.35 were excluded from the set.

In Vitro Dual-Glo® Screening

Cell Culture and Transfections

Cos 7 cells (ATCC, Manassas, Va.) were grown to near confluence at 37° C. in an atmosphere of 5% $CO_2$ in DMEM (ATCC) supplemented with 10% FBS, before being released from the plate by trypsinization. Dual-Glo® Luciferase constructs were generated in the psiCHECK2 plasmid and contained approximately 2.0 kb (human) IGFALS sequences (SEQ ID NO: 23). Dual-luciferase plasmids were co-transfected with double stranded agents into 3000 cells using Lipofectamine RNAiMax (Invitrogen, Carlsbad Calif. cat #13778-150). For each well of a 384 well plate, 0.1 µl of Lipofectamine was added to 3 ng of plasmid vector and agent in 15 µl of Opti-MEM and allowed to complex at room temperature for 15 minutes. The mixture was then added to the cells resuspended in 35 ul of fresh complete media. Cells were incubated for 48 hours before luciferase was measured. Single dose experiments were performed at 10 nM final duplex concentration.

Dual-Glo® Luciferase Assay

Forty-eight hours after the siRNAs were transfected, Firefly (transfection control) and *Renilla* (fused to IGFALS target sequence in 3' UTR, SEQ ID NO: 23) luciferase were measured. First, media was removed from cells. Then Firefly luciferase activity was measured by adding 20 µl of Dual-Glo® Luciferase Reagent mixed with 20 µl of complete media to each well. The mixture was incubated at room temperature for 30 minutes before luminescense (500 nm) was measured on a Spectramax (Molecular Devices) to detect the Firefly luciferase signal. *Renilla* luciferase activity was measured by adding 20 ul of room temperature of Dual-Glo® Stop & Glo® Reagent to each well and the plates were incubated for 20 minutes before luminescence was again measured to determine the *Renilla* luciferase signal. The Dual-Glo® Stop & Glo® Reagent quenched the firefly luciferase signal and sustained luminescence for the *Renilla* luciferase reaction. Double stranded RNAi agent activity was determined by normalizing the *Renilla* (IGFALS) signal to the Firefly (control) signal within each well. The magnitude of agent activity was then assessed relative to cells that were transfected with the same vector but were not treated with agent or were treated with a non-targeting double stranded RNAi agent. All transfections were done in quadruplicates.

TABLE 6

Unmodified Sense and Antisense Strand Sequences of IGFALS dsRNAs

| Duplex Name | Sense Oligo Name | Sense oligo sequence | SEQ ID NO | Range | Antisense Oligo Name | Antisense oligo sequence | SEQ ID NO | Range in SEQ ID NO: 1 |
|---|---|---|---|---|---|---|---|---|
| AD-73764 | A-147667 | AGGGCAGGGGUGGCCGGCA | 256 | 11-29 | A-147668 | UGCCGGCCACCCCUGCCCU | 441 | 11-29 |
| AD-73765 | A-147669 | CCGGCACAGCAGACGUACA | 257 | 24-42 | A-147670 | UGUACGUCUGCUGUGCCGG | 442 | 24-42 |
| AD-73766 | A-147671 | AGACGUACCCCUCCCUCCU | 258 | 34-52 | A-147672 | AGCGAGGGAGGGUACGUCU | 443 | 34-52 |
| AD-73767 | A-147673 | UCCCUGCUGCCUGCCUGA | 259 | 44-62 | A-147674 | UCAGGCAGGCAGCGAGGGA | 444 | 44-62 |
| AD-73768 | A-147675 | UGCCUGCAGCCUGCCUGA | 260 | 56-74 | A-147676 | UCAGGGCAGGCUGCAGGCA | 445 | 56-74 |
| AD-73769 | A-147677 | UGCCUGCAUGCAGGAUGA | 261 | 67-85 | A-147678 | UCAUCCUGCAUGCAGGGCA | 446 | 67-85 |
| AD-73770 | A-147679 | AGGAUGGCCCUGAGGAAAG | 262 | 79-97 | A-147680 | CUUUCCUCAGGGCCAUCCU | 447 | 79-97 |
| AD-73771 | A-147681 | CUGAGGAAAGGAGGCCUGA | 263 | 88-106 | A-147682 | UCAGGCCUCCUUUCCUCAG | 448 | 88-106 |
| AD-73772 | A-147683 | AGGCCUGGCCCUGGCGCUA | 264 | 99-117 | A-147684 | UAGCGCCAGGGCCAGGCCU | 449 | 99-117 |
| AD-73773 | A-147685 | GCGCUGCUGCUGCUGUCCU | 265 | 112-130 | A-147686 | AGGACAGCAGCAGCAGCGC | 450 | 112-130 |
| AD-73774 | A-147687 | UGCUGUCCUGGGUGGCACU | 266 | 122-140 | A-147688 | AGUGCCACCCAGGACAGCA | 451 | 122-140 |
| AD-73775 | A-147689 | UGGCACUGGGCCCCCGCAA | 267 | 134-152 | A-147690 | UUGCGGGGGCCCAGUGCCA | 452 | 134-152 |
| AD-73776 | A-147691 | GCCCCGCAGCCUGGAGGA | 268 | 143-161 | A-147692 | UCCUCCAGGCUGCGGGGGC | 453 | 143-161 |
| AD-73777 | A-147693 | UGGAGGGAGCAGACCCCGA | 269 | 155-173 | A-147694 | UCGGGGUCUGCUCCCUCCA | 454 | 155-173 |
| AD-73778 | A-147695 | AGACCCCGGAACGCCGGGA | 270 | 165-183 | A-147696 | UCCCGGCGUUCCGGGGUCU | 455 | 165-183 |
| AD-73779 | A-147697 | CGCCGGGGAAGCCGAGGA | 271 | 176-194 | A-147698 | UCCUCGGCUUCCCCCGGCG | 456 | 176-194 |
| AD-73780 | A-147699 | CGAGGGGCCAGCGUGCCCA | 272 | 189-207 | A-147700 | UGGGCACGCUGGCCCUCG | 457 | 189-207 |
| AD-73781 | A-147701 | AGCGUGCCCGGCCGCCUGU | 273 | 198-216 | A-147702 | ACAGGCGGCCGGGCACGCU | 458 | 198-216 |
| AD-73782 | A-147703 | GCCUGUGUCUGCAGCUACA | 274 | 211-229 | A-147704 | UGUAGCUGCAGACACAGGC | 459 | 211-229 |
| AD-73783 | A-147705 | UGCAGCUACGAUGACGACA | 275 | 220-238 | A-147706 | UGUCGUCAUCGUAGCUGCA | 460 | 220-238 |
| AD-73784 | A-147707 | GACGACGCGGAUGAGAGCUCA | 276 | 232-250 | A-147708 | UGAGCUCAUCCGCGUCGUC | 461 | 232-250 |
| AD-73785 | A-147709 | AUGAGCUCAGCCUCUUCUA | 277 | 242-260 | A-147710 | UAGAAGAGCUGAGCUCAU | 462 | 242-260 |
| AD-73786 | A-147711 | UCUUCUGCAGCUCCAGGAA | 278 | 254-272 | A-147712 | UUCCUGGAGCUGCAGAAGA | 463 | 254-272 |

TABLE 6-continued

Unmodified Sense and Antisense Strand Sequences of IGFALS dsRNAs

| Duplex Name | Sense Oligo Name | Sense oligo sequence | SEQ ID NO | Range | Antisense Oligo Name | Antisense oligo sequence | SEQ ID NO | Range in SEQ ID NO: 1 |
|---|---|---|---|---|---|---|---|---|
| AD-73787 | A-147713 | UCCAGGAACCUCACGCGCA | 279 | 265-283 | A-147714 | UGCGCGUGAGGUUCCUGGA | 464 | 265-283 |
| AD-73788 | A-147715 | UCACGCGCCUGCCUGAUGA | 280 | 275-293 | A-147716 | UCAUCAGGCAGGCGCGUGA | 465 | 275-293 |
| AD-73789 | A-147717 | UGAUGGAGUCCCGGGCCGA | 281 | 288-306 | A-147718 | UCCGCCCGGGACUCCAUCA | 466 | 288-306 |
| AD-73790 | A-147719 | CGGGCGCACCCAAGCCCU | 282 | 299-317 | A-147720 | AGGGCUUGGGUGCCGCCCG | 467 | 299-317 |
| AD-73791 | A-147721 | CAAGCCCUGUGGCUGGACA | 283 | 310-328 | A-147722 | UGUCCAGCCACAGGGCUUG | 468 | 310-328 |
| AD-73792 | A-147723 | UGGCUGGACGGCAACAACA | 284 | 319-337 | A-147724 | UGUUGUUGCCGUCCAGCCA | 469 | 319-337 |
| AD-73793 | A-147725 | AACAACUCUCGUCCUCA | 285 | 331-349 | A-147726 | UGACGGACGAGAGGUUGUU | 470 | 331-349 |
| AD-73794 | A-147727 | UCCGUCCCCGGCAGCCU | 286 | 343-361 | A-147728 | AGGCUGCCGGGGGACGGA | 471 | 343-361 |
| AD-73795 | A-147729 | CGGCAGCCUUCCAGAACCU | 287 | 353-371 | A-147730 | AGGUUCUGGAAGGCUGCCG | 472 | 353-371 |
| AD-73796 | A-147731 | CAGAACCUCUCCAGCCUGA | 288 | 364-382 | A-147732 | UCAGGCUGGAGAGGUUCUG | 473 | 364-382 |
| AD-73797 | A-147733 | AGCCUGGGCUUCCUCAACA | 289 | 376-394 | A-147734 | UGUUGAGGAAGCCCAGGCU | 474 | 376-394 |
| AD-73798 | A-147735 | UUCCUCAACCUGCAGGGCA | 290 | 385-403 | A-147736 | UGCCCUGCAGGUUGAGGAA | 475 | 385-403 |
| AD-73799 | A-147737 | CAGGGCGGCCAGCUGGCA | 291 | 397-415 | A-147738 | UGCCAGCUGGCCGCCCUG | 476 | 397-415 |
| AD-73800 | A-147739 | AGCUGGCAGCCUGGAGCA | 292 | 407-425 | A-147740 | UGCUCCAGGCUGCCCAGCU | 477 | 407-425 |
| AD-73801 | A-147741 | CUGGAGCCACAGGCGCUGA | 293 | 418-436 | A-147742 | UCAGCGCCUGUGGCUCCAG | 478 | 418-436 |
| AD-73802 | A-147743 | CGCUGCUGGGCCUAGAGAA | 294 | 431-449 | A-147744 | UUCUCUAGGCCCAGCAGCG | 479 | 431-449 |
| AD-73803 | A-147745 | CUAGAGAACCUGUGCCACA | 295 | 442-460 | A-147746 | UGUGGCACAGGUUCUCUAG | 480 | 442-460 |
| AD-73804 | A-147747 | UGUGCCACCUGCACCUGGA | 296 | 452-470 | A-147748 | UCCAGGUGCAGGUGGCACA | 481 | 452-470 |
| AD-73805 | A-147749 | ACCUGGAGCGGAACCAGCU | 297 | 464-482 | A-147750 | AGCUGGUUCCGCUCCAGGU | 482 | 464-482 |
| AD-73806 | A-147751 | AACCAGCUGCCAGCCUGA | 298 | 475-493 | A-147752 | UCAGGCUGCGCAGCUGGUU | 483 | 475-493 |
| AD-73807 | A-147753 | CGCAGCUGGCACUCGGCA | 299 | 484-502 | A-147754 | UGCCGAGUGCCAGGCUGCG | 484 | 484-502 |
| AD-73808 | A-147755 | UCGGGCACGUUUGCACAA | 300 | 497-515 | A-147756 | UUGUGUGCAAACGUGCCGA | 485 | 497-515 |
| AD-73809 | A-147757 | UUGCACACACCCCCGCGCU | 301 | 506-524 | A-147758 | AGCGCGGGGGUGUGUGCAA | 486 | 506-524 |

TABLE 6-continued

Unmodified Sense and Antisense Strand Sequences of IGFALS dsRNAs

| Duplex Name | Sense Oligo Name | Sense oligo sequence | SEQ ID NO | Range | Antisense Oligo Name | Antisense oligo sequence | SEQ ID NO | Range in SEQ ID NO: 1 |
|---|---|---|---|---|---|---|---|---|
| AD-73810 | A-147759 | CCCGCGCUGGCCUCGCUCA | 302 | 517-535 | A-147760 | UGAGCGAGGCCAGCGCGGG | 487 | 517-535 |
| AD-73811 | A-147761 | UCGCUCGGCCUCAGCAACA | 303 | 529-547 | A-147762 | UGUUGCUGAGGCCGAGCGA | 488 | 529-547 |
| AD-73812 | A-147763 | AGCAACAACCGUCUGAGCA | 304 | 541-559 | A-147764 | UGCUCAGACGGUUGUUGCU | 489 | 541-559 |
| AD-73813 | A-147767 | CUGGAGGACGGGCUCUUCA | 305 | 562-580 | A-147768 | UGAAGAGCCCGUCCUCCAG | 490 | 562-580 |
| AD-73814 | A-147769 | CUCUUCGAGGGCCUCGCA | 306 | 574-592 | A-147770 | UGCCGAGGCCCUCGAAGAG | 491 | 574-592 |
| AD-73815 | A-147771 | GGCCUCGGCAGCCUCUGGA | 307 | 583-601 | A-147772 | UCCAGAGGCUGCCGAGGCC | 492 | 583-601 |
| AD-73816 | A-147773 | UCUGGGACCUCAACCUCGA | 308 | 596-614 | A-147774 | UCGAGGUUGAGGUCCCAGA | 493 | 596-614 |
| AD-73817 | A-147775 | AACCUCGGCUGGAAUAGCA | 309 | 607-625 | A-147776 | UGCUAUUCCAGCCGAGGUU | 494 | 607-625 |
| AD-73818 | A-147777 | UGGAAUAGCUGGCCGGUGA | 310 | 616-634 | A-147778 | UCACCGCCAGCCUAUUCCA | 495 | 616-634 |
| AD-73819 | A-147779 | CGGUGCUCCCCGAUGCGGA | 311 | 629-647 | A-147780 | UCCGCAUCGGGGAGCACCG | 496 | 629-647 |
| AD-73820 | A-147781 | GAUGCGGCGCGUUCCGCGCA | 312 | 640-658 | A-147782 | UGCCGCGGAACGCCGCAUC | 497 | 640-658 |
| AD-73821 | A-147783 | UUCCGCGGCCUGGCGGAGCA | 313 | 649-667 | A-147784 | UGCUGCCCAGGCCGCGGAA | 498 | 649-667 |
| AD-73822 | A-147785 | GCAGCCUGCGGCGAGCUGGU | 314 | 662-680 | A-147786 | ACCAGCUCGCCGCAGGCUC | 499 | 662-680 |
| AD-73823 | A-147787 | GAGCUGGUGCUGGGCGGCA | 315 | 673-691 | A-147788 | UGCCGCCCAGCACCAGCUC | 500 | 673-691 |
| AD-73824 | A-147789 | CUGGGCGGCAACAGGCUGA | 316 | 682-700 | A-147790 | UCAGCCUGUUGCCGCCCAG | 501 | 682-700 |
| AD-73825 | A-147791 | AGGCUGGCCUUACCUGCAGA | 317 | 694-712 | A-147792 | UCUGCAGGUAGGCCAGCCU | 502 | 694-712 |
| AD-73826 | A-147793 | ACCUGCAGCCCCGCUCUU | 318 | 704-722 | A-147794 | AAGAGCGGGGCUGCAGGU | 503 | 704-722 |
| AD-73827 | A-147795 | CGCUCUUCAGCGGCCUUGA | 319 | 716-734 | A-147796 | UCCAGGCCGCUGAAGAGCG | 504 | 716-734 |
| AD-73828 | A-147797 | CGGCCUGGCCGAGCUCCGA | 320 | 726-744 | A-147798 | UCGGAGCUCGGCCAGGCCG | 505 | 726-744 |
| AD-73829 | A-147799 | AGCUCCGGAGCUGGACCU | 321 | 737-755 | A-147800 | AGGUCCAGCUCCGGAGCU | 506 | 737-755 |
| AD-73830 | A-147801 | CUGGACCUGAGCAGGAACA | 322 | 748-766 | A-147802 | UGUUCCUGCUCAGGUCCAG | 507 | 748-766 |
| AD-73831 | A-147803 | AGGAACGCGCUGCGGGCCA | 323 | 760-778 | A-147804 | UGGCCCGCAGCGCGUUCCU | 508 | 760-778 |
| AD-73832 | A-147805 | CGGGCCAUCAAGGCAAACA | 324 | 772-790 | A-147806 | UGUUUGCCUUGAUGGCCCG | 509 | 772-790 |
| AD-73833 | A-147807 | AAGGCAAACGUGUUCGUGA | 325 | 781-799 | A-147808 | UCACGAACACGUUUGCCUU | 510 | 781-799 |

TABLE 6-continued

Unmodified Sense and Antisense Strand Sequences of IGFALS dsRNAs

| Duplex Name | Sense Oligo Name | Sense oligo sequence | SEQ ID NO | Range | Antisense Oligo Name | Antisense oligo sequence | SEQ ID NO | Range in SEQ ID NO: 1 |
|---|---|---|---|---|---|---|---|---|
| AD-73834 | A-147809 | UUCGUGCAGCUGCCCCGGA | 326 | 793-811 | A-147810 | UCCGGGGCAGCUGCACGAA | 511 | 793-811 |
| AD-73835 | A-147813 | AGAAACUCUACCUGGACCA | 327 | 815-833 | A-147814 | UGGUCCAGGUAGAGUUUCU | 512 | 815-833 |
| AD-73836 | A-147815 | CCUGGACCGCAACCUCAUA | 328 | 825-843 | A-147816 | UAUGAGGUUGCGGUCCAGG | 513 | 825-843 |
| AD-73837 | A-147817 | CCUCAUCGCUGCCGUGGCA | 329 | 837-855 | A-147818 | UGCCACGGCAGCGAUGAGG | 514 | 837-855 |
| AD-73838 | A-147819 | CGUGGCCCGGGCGCCUUA | 330 | 849-867 | A-147820 | UAAGGCGCCCGGGCCACG | 515 | 849-867 |
| AD-73839 | A-147821 | GGCGCCUUCCUGGGCCUGA | 331 | 859-877 | A-147822 | UCAGGCCCAGGAAGGCGCC | 516 | 859-877 |
| AD-73840 | A-147823 | UGGGCCUGAAGGCGCUGCA | 332 | 869-887 | A-147824 | UGCAGCGCCUUCAGGCCCA | 517 | 869-887 |
| AD-73841 | A-147825 | CGCUGCGAUGGCUGGACCU | 333 | 881-899 | A-147826 | AGGUCCAGCCAUCGCAGCG | 518 | 881-899 |
| AD-73842 | A-147827 | UGGACCUGUCCACAACCA | 334 | 893-911 | A-147828 | UGGUUGUGGACAGGUCCA | 519 | 893-911 |
| AD-73843 | A-147829 | CACAACCGCUGCCUGGCA | 335 | 904-922 | A-147830 | UGCCAGGCACGCGGUUGUG | 520 | 904-922 |
| AD-73844 | A-147831 | UGGCUGGCCUCCUGGAGGA | 336 | 914-932 | A-147832 | UCCUCCAGGAGGCCAGCCA | 521 | 914-932 |
| AD-73845 | A-147833 | CCUGGAGGACACGUUCCCA | 337 | 924-942 | A-147834 | UGGGAACGUGUCCUCCAGG | 522 | 924-942 |
| AD-73846 | A-147835 | UUCCCCGGUCUGCUGGCA | 338 | 937-955 | A-147836 | UGCCCAGCAGACCGGGGAA | 523 | 937-955 |
| AD-73847 | A-147837 | UGCUGGGCCUGCGUGUGCU | 339 | 947-965 | A-147838 | AGCACACGCAGGCCCAGCA | 524 | 947-965 |
| AD-73848 | A-147839 | CGUGUGCUGCGGCUGUCCA | 340 | 958-976 | A-147840 | UGGACAGCCGCAGCACACG | 525 | 958-976 |
| AD-73849 | A-147841 | CUGUCCCACAACGCCAUCA | 341 | 970-988 | A-147842 | UGAUGGCGUUGUGGGACAG | 526 | 970-988 |
| AD-73850 | A-147843 | AACGCCAUCGCCAGCCUGA | 342 | 979-997 | A-147844 | UCAGGCUGGCGAUGGCGUU | 527 | 979-997 |
| AD-73851 | A-147845 | AGCCUGCGGCCCGCCACCU | 343 | 991-1009 | A-147846 | AGGUGCGGGGCCGCAGGCU | 528 | 991-1009 |
| AD-73852 | A-147847 | CGCACCUUCAAGGACCUGA | 344 | 1003-1021 | A-147848 | UCAGGUCCUUGAAGGUGCG | 529 | 1003-1021 |
| AD-73853 | A-147849 | AAGGACCUGCACUUCCUGA | 345 | 1012-1030 | A-147850 | UCAGGAAGUGCAGGUCCUU | 530 | 1012-1030 |
| AD-73854 | A-147851 | UUCCUGGAGGAGCUGCAGA | 346 | 1024-1042 | A-147852 | UCUGCAGCUCCUCCAGGAA | 531 | 1024-1042 |
| AD-73855 | A-147853 | CUGCAGCUGGGCCACAACA | 347 | 1036-1054 | A-147854 | UGUUGUGGCCCAGCUGCAG | 532 | 1036-1054 |
| AD-73856 | A-147855 | CCACAACCGCAUCCGGCAA | 348 | 1047-1065 | A-147856 | UUGCCGGAUGCGGUUGUGG | 533 | 1047-1065 |

TABLE 6-continued

Unmodified Sense and Antisense Strand Sequences of IGFALS dsRNAs

| Duplex Name | Sense Oligo Name | Sense oligo sequence | SEQ ID NO | Range | Antisense Oligo Name | Antisense oligo sequence | SEQ ID NO | Range in SEQ ID NO: 1 |
|---|---|---|---|---|---|---|---|---|
| AD-73857 | A-147857 | UCCGGCAGCUGGCUGAGCA | 349 | 1058-1076 | A-147858 | UGCUCAGCCAGCUGCCGGA | 534 | 1058-1076 |
| AD-73858 | A-147859 | UGGCUGAGCGCAGCUUUGA | 350 | 1067-1085 | A-147860 | UCAAAGCUGCGCUCAGCCA | 535 | 1067-1085 |
| AD-73859 | A-147861 | AGCUUUGAGGGCCUGGGGA | 351 | 1078-1096 | A-147862 | UCCCCAGGCCCUCAAAGCU | 536 | 1078-1096 |
| AD-73860 | A-147863 | UGGGGCAGCUUGAGGUGCU | 352 | 1091-1109 | A-147864 | AGCACCUCAAGCUGCCCCA | 537 | 1091-1109 |
| AD-73861 | A-147865 | UUGAGGUGCUCACGCUAGA | 353 | 1100-1118 | A-147866 | UCUAGCGUGAGCACCUCAA | 538 | 1100-1118 |
| AD-73862 | A-147867 | ACGCUAGACCACAACCAGA | 354 | 1111-1129 | A-147868 | UCUGGUUGUGGUCUAGCGU | 539 | 1111-1129 |
| AD-73863 | A-147869 | AACCAGCUCCAGGAGGUCA | 355 | 1123-1141 | A-147870 | UGACCUCCUGGAGCUGGUU | 540 | 1123-1141 |
| AD-73864 | A-147871 | AGGAGGUCAAGGCGGGCGA | 356 | 1133-1151 | A-147872 | UCGCCCGCCUUGACCUCCU | 541 | 1133-1151 |
| AD-73865 | A-147873 | CGGGCGCUUUCCUCGGCCU | 357 | 1145-1163 | A-147874 | AGGCCGAGGAAAGCGCCCG | 542 | 1145-1163 |
| AD-73866 | A-147875 | CUCGGCCUCACCAACGUGA | 358 | 1156-1174 | A-147876 | UCACGUUGGUGAGGCCGAG | 543 | 1156-1174 |
| AD-73867 | A-147877 | AACGUGGCGGUCAUGAACA | 359 | 1168-1186 | A-147878 | UGUUCAUGACCGCCACGUU | 544 | 1168-1186 |
| AD-73868 | A-147879 | UCAUGAACCUCUCUCUGGAA | 360 | 1178-1196 | A-147880 | UUCCAGAGAGGUUCAUGA | 545 | 1178-1196 |
| AD-73869 | A-147881 | UCUGGGAACUGUCUCCGGA | 361 | 1189-1207 | A-147882 | UCCGGAGACAGUUCCCAGA | 546 | 1189-1207 |
| AD-73870 | A-147883 | UCUCCGGAACCUUCCGGAA | 362 | 1200-1218 | A-147884 | UUCCGGAAGGUUCCGGAGA | 547 | 1200-1218 |
| AD-73871 | A-147885 | UUCCGGAGCAGGUGUUCCA | 363 | 1211-1229 | A-147886 | UGGAACACCUGCUCCGGAA | 548 | 1211-1229 |
| AD-73872 | A-147887 | GGUGUUCCGGGGCCUGGGA | 364 | 1221-1239 | A-147888 | UCCCAGGCCCCGGAACACC | 549 | 1221-1239 |
| AD-73873 | A-147889 | CUGGGCAAGCUGCCACACA | 365 | 1234-1252 | A-147890 | UGCUGUGCAGCUUGCCCAG | 550 | 1234-1252 |
| AD-73874 | A-147891 | UGCACAGCCUGCCACCUGA | 366 | 1244-1262 | A-147892 | UCCAGGUCCAGGCUGUGCA | 551 | 1244-1262 |
| AD-73875 | A-147895 | CAGCUGCCUGGGACGCAUA | 367 | 1266-1284 | A-147896 | UAUGCGUCCCAGGCAGCUG | 552 | 1266-1284 |
| AD-73876 | A-147897 | GACGCAUCCGCCCGACAA | 368 | 1277-1295 | A-147898 | UUGUGCGGGCGGAUGCGUC | 553 | 1277-1295 |
| AD-73877 | A-147899 | CGCACACCUUCACCGGCCU | 369 | 1289-1307 | A-147900 | AGGCCGGUGAAGGUGUGCG | 554 | 1289-1307 |
| AD-73878 | A-147901 | UCACCGGCCUCUCGGGGCU | 370 | 1298-1316 | A-147902 | AGCCCCGAGAGGCCGGUGA | 555 | 1298-1316 |
| AD-73879 | A-147903 | UCGGGGCUCCGCCGACUCU | 371 | 1309-1327 | A-147904 | AGAGUCGGCGGAGCCCCGA | 556 | 1309-1327 |
| AD-73880 | A-147905 | CGACUCUUCCUCAAGGACA | 372 | 1321-1339 | A-147906 | UGUCCUUGAGGAAGAGUCG | 557 | 1321-1339 |

TABLE 6-continued

Unmodified Sense and Antisense Strand Sequences of IGFALS dsRNAs

| Duplex Name | Sense Oligo Name | Sense oligo sequence | SEQ ID NO | Range | Antisense Oligo Name | SEQ ID NO | Antisense oligo sequence | Range in SEQ ID NO: 1 |
|---|---|---|---|---|---|---|---|---|
| AD-73881 | A-147907 | CAAGGACAACGCCUCGUA | 373 | 1332-1350 | A-147908 | 558 | UACGAGGCCGUUGUCCUUG | 1332-1350 |
| AD-73882 | A-147909 | GGCCUCGUGGGCAUUGAGA | 374 | 1342-1360 | A-147910 | 559 | UCUCAAUGCCCACGAGGCC | 1342-1360 |
| AD-73883 | A-147911 | UUGAGGAGCAGAGCCUGUA | 375 | 1355-1373 | A-147912 | 560 | UACAGGCUCUGCUCCUCAA | 1355-1373 |
| AD-73884 | A-147913 | AGAGCCUGUGGGGCUGGA | 376 | 1364-1382 | A-147914 | 561 | UCCAGCCCCCACAGGCUCU | 1364-1382 |
| AD-73885 | A-147915 | GGGCUGGCGAGCUGCUGA | 377 | 1375-1393 | A-147916 | 562 | UCAGCAGCUCCGCCAGCCC | 1375-1393 |
| AD-73886 | A-147917 | UGCUGGAGCUCGACCUGAA | 378 | 1388-1406 | A-147918 | 563 | UUCAGGUCGAGCUCCAGCA | 1388-1406 |
| AD-73887 | A-147919 | GACCUGACCUCCAACCAGA | 379 | 1399-1417 | A-147920 | 564 | UCUGGUUGGAGGUCAGGUC | 1399-1417 |
| AD-73888 | A-147921 | UCCAACCAGCUCACGCACA | 380 | 1408-1426 | A-147922 | 565 | UGUGCGUGAGCUGGUUGGA | 1408-1426 |
| AD-73889 | A-147923 | ACGCACCUGCCCCACCCA | 381 | 1420-1438 | A-147924 | 566 | UGCGGUGGGGCAGGUGCGU | 1420-1438 |
| AD-73890 | A-147925 | CACCGCCCUCUUCCAGGCA | 382 | 1432-1450 | A-147926 | 567 | UGCCCUGGAAGAGGCGGUG | 1432-1450 |
| AD-73891 | A-147927 | UCCAGGGCCUGGCAAGCU | 383 | 1442-1460 | A-147928 | 568 | AGCUUGCCCAGGCCCUGGA | 1442-1460 |
| AD-73892 | A-147929 | GCAAGCUGGAGUACCUGCU | 384 | 1454-1472 | A-147930 | 569 | AGCAGGUACUCCAGCUUGC | 1454-1472 |
| AD-73893 | A-147931 | UACCUGCUGCUCUCCCCCA | 385 | 1465-1483 | A-147932 | 570 | UGCGGGAGAGCAGCAGGUA | 1465-1483 |
| AD-73894 | A-147933 | CUCUCCCGCAACCGCUGA | 386 | 1474-1492 | A-147934 | 571 | UCAGGCCGUUGCGGGAGAG | 1474-1492 |
| AD-73895 | A-147935 | CCGCCUGGCAGAGCUGCCA | 387 | 1485-1503 | A-147936 | 572 | UGGCAGCUCUGCCAGGCGG | 1485-1503 |
| AD-73896 | A-147937 | AGCUGCCGGCCGACGCCCU | 388 | 1496-1514 | A-147938 | 573 | AGGGCGUCGGCCGGCAGCU | 1496-1514 |
| AD-73897 | A-147939 | GACGCCCUGGGCCCCCUGA | 389 | 1507-1525 | A-147940 | 574 | UCAGGGGGCCCAGGGCGUC | 1507-1525 |
| AD-73898 | A-147941 | CCCCUGCAGCGGGCCUUCU | 390 | 1519-1537 | A-147942 | 575 | AGAAGGCCCGCUGCAGGGG | 1519-1537 |
| AD-73899 | A-147943 | GGGCCUUCUGGCUGGACGU | 391 | 1529-1547 | A-147944 | 576 | ACGUCCAGCCAGAAGGCCC | 1529-1547 |
| AD-73900 | A-147945 | UGGACGUCUCGCACAACCA | 392 | 1541-1559 | A-147946 | 577 | UGGUUGUGCGAGACGUCCA | 1541-1559 |
| AD-73901 | A-147947 | ACAACCCGCCUGGAGGCAUU | 393 | 1553-1571 | A-147948 | 578 | AAUGCCUCCAGGCGGUUGU | 1553-1571 |
| AD-73902 | A-147949 | GAGGCAUUGCCCAAACAGCA | 394 | 1564-1582 | A-147950 | 579 | UGCUGUUUGGGCAAUGCCUC | 1564-1582 |
| AD-73903 | A-147951 | CAACAGCCUCUCUUGGACCA | 395 | 1575-1593 | A-147952 | 580 | UGGUCCAAGAGAGGCUGUUG | 1575-1593 |

TABLE 6-continued

Unmodified Sense and Antisense Strand Sequences of IGFALS dsRNAs

| Duplex Name | Sense Oligo Name | Sense oligo sequence | SEQ ID NO | Range | Antisense Oligo Name | Antisense oligo sequence | SEQ ID NO | Range in SEQ ID NO: 1 |
|---|---|---|---|---|---|---|---|---|
| AD-73904 | A-147953 | UUGGCACCACUGGGGCGGA | 396 | 1585-1603 | A-147954 | UCCGCCCCAGUGUGCCAA | 581 | 1585-1603 |
| AD-73905 | A-147955 | UGGGGCGGCUGCGCUACCU | 397 | 1595-1613 | A-147956 | AGUAGCGCAGCCGCCCCA | 582 | 1595-1613 |
| AD-73906 | A-147957 | CGCUACCUCAGCCUCAGGA | 398 | 1606-1624 | A-147958 | UCCUGAGGCUGAGGUAGCG | 583 | 1606-1624 |
| AD-73907 | A-147959 | UCAGGAACAACUCACUGCA | 399 | 1619-1637 | A-147960 | UGCAGUGAGUUGUUCCUGA | 584 | 1619-1637 |
| AD-73908 | A-147961 | CUCACUGCGGACCUUCACA | 400 | 1629-1647 | A-147962 | UGUGAAGGUCCGCAGUGAG | 585 | 1629-1647 |
| AD-73909 | A-147963 | ACCUUCACGCCGCAGCCCA | 401 | 1639-1657 | A-147964 | UGGGCUGCGGCGUGAAGGU | 586 | 1639-1657 |
| AD-73910 | A-147965 | CAGCCCCCGGGCCUGGAGA | 402 | 1651-1669 | A-147966 | UCUCCAGGCCCGGGGGCUG | 587 | 1651-1669 |
| AD-73911 | A-147967 | GCCUGGAGCGCCUGUGGCU | 403 | 1661-1679 | A-147968 | AGCCACAGGCGCUCCAGGC | 588 | 1661-1679 |
| AD-73912 | A-147969 | CUGUGGCUGGAGGGUAACA | 404 | 1672-1690 | A-147970 | UGUUACCCUCCAGCCACAG | 589 | 1672-1690 |
| AD-73913 | A-147971 | GGUAACCCUGGACUGUA | 405 | 1684-1702 | A-147972 | UACAGUCCCAGGGGUUACC | 590 | 1684-1702 |
| AD-73914 | A-147973 | GGGACUGUGGCUGCCCUCU | 406 | 1694-1712 | A-147974 | AGAGGGCAGCCACAGUCCC | 591 | 1694-1712 |
| AD-73915 | A-147975 | UGCCCUCUCAAGGCGCUGA | 407 | 1705-1723 | A-147976 | UCAGCGCCUUGAGAGGGCA | 592 | 1705-1723 |
| AD-73916 | A-147977 | CGCUGGGGACUUCGCCCCU | 408 | 1718-1736 | A-147978 | AGGGGCGAAGUCCGCAGGG | 593 | 1718-1736 |
| AD-73917 | A-147979 | UUCGCCCCUGCAGAACCCA | 409 | 1729-1747 | A-147980 | UGGGGUUCUGCAGGGCGAA | 594 | 1729-1747 |
| AD-73918 | A-147981 | CAGAACCCAGUGCUGUGA | 410 | 1738-1756 | A-147982 | UCACAGCACUGGGGUUCUG | 595 | 1738-1756 |
| AD-73919 | A-147983 | UGCUGUGCCCCGCUUCCUA | 411 | 1749-1767 | A-147984 | UACGAAGCGGGGCACAGCA | 596 | 1749-1767 |
| AD-73920 | A-147985 | CUUCGUCCAGCCAUCUGU | 412 | 1761-1779 | A-147986 | ACAGAUGGCCUGGACGAAG | 597 | 1761-1779 |
| AD-73921 | A-147987 | CAUCUGUGAGGGGACCAU | 413 | 1773-1791 | A-147988 | AUCGUCCCCUCACAGAUG | 598 | 1773-1791 |
| AD-73922 | A-147989 | GGGGACGAUUGCCAGCCGA | 414 | 1783-1801 | A-147990 | UCGGCUGGCAAUCGUCCCC | 599 | 1783-1801 |
| AD-73923 | A-147991 | CAGCCGCCGCUACACCU | 415 | 1795-1813 | A-147992 | AGGUGUACGCGGCGCGGUG | 600 | 1795-1813 |
| AD-73924 | A-147993 | CGUACACCUACAACAACAU | 416 | 1805-1823 | A-147994 | AUGUUGUUGUAGGUGUACG | 601 | 1805-1823 |
| AD-73925 | A-147995 | AACAACAUCACCACGUGCCA | 417 | 1816-1834 | A-147996 | UGGCACAGGUGAUGUUGUU | 602 | 1816-1834 |
| AD-73926 | A-147997 | UGUGCCAGCCCGCCCGAGA | 418 | 1828-1846 | A-147998 | UCUCGGGCGGGCUGGCACA | 603 | 1828-1846 |
| AD-73927 | A-147999 | CGCCCGAGGUCGUGGGCU | 419 | 1838-1856 | A-148000 | AGCCCCACGACCUCGGGCG | 604 | 1838-1856 |

TABLE 6-continued

Unmodified Sense and Antisense Strand Sequences of IGFALS dsRNAs

| Duplex Name | Sense Oligo Name | Sense oligo sequence | SEQ ID NO | Range | Antisense Oligo Name | Antisense oligo sequence | SEQ ID NO | Range in SEQ ID NO: 1 |
|---|---|---|---|---|---|---|---|---|
| AD-73928 | A-148001 | CGUGGGCUCGACCUGCGA | 420 | 1848-1866 | A-148002 | UCGCAGGUCGAGCCCCACG | 605 | 1848-1866 |
| AD-73929 | A-148003 | ACCUGCGGGACCUCAGCGA | 421 | 1859-1877 | A-148004 | UCGCUGAGGUCCCGCAGGU | 606 | 1859-1877 |
| AD-73930 | A-148005 | UCAGCGAGGCCCACUUUGA | 422 | 1871-1889 | A-148006 | UCAAAGUGGGCCUCGCUGA | 607 | 1871-1889 |
| AD-73931 | A-148007 | ACUUUGCUCCCUGCUGACA | 423 | 1883-1901 | A-148008 | UGUCAGCAGGGAGCAAAGU | 608 | 1883-1901 |
| AD-73932 | A-148009 | CCUGCUGACCAGGUCCCCA | 424 | 1892-1910 | A-148010 | UGGGGACCUGGUCAGCAGG | 609 | 1892-1910 |
| AD-73933 | A-148011 | UCCCCGACUCAAGCCCCA | 425 | 1905-1923 | A-148012 | UGGGGCUUGAGUCCGGGGA | 610 | 1905-1923 |
| AD-73934 | A-148013 | CAAGCCCGGACUCAGGCA | 426 | 1915-1933 | A-148014 | UGCCUGAGUCCGGGCUUG | 611 | 1915-1933 |
| AD-73935 | A-148015 | UCAGGCCCCACCUGGCUA | 427 | 1927-1945 | A-148016 | UAGCCAGGUGGGGCCUGA | 612 | 1927-1945 |
| AD-73936 | A-148017 | ACCUGGCUCACCUUGUGCU | 428 | 1937-1955 | A-148018 | AGCACAAGGUGAGCCAGGU | 613 | 1937-1955 |
| AD-73937 | A-148019 | UUGUGCUGGGGACAGGUCA | 429 | 1949-1967 | A-148020 | UGACCUGUCCCAGCACAA | 614 | 1949-1967 |
| AD-73938 | A-148021 | GACAGGUCCUCAGUGUCCU | 430 | 1959-1977 | A-148022 | AGGACACUGAGGACCUGUC | 615 | 1959-1977 |
| AD-73939 | A-148023 | CAGUGUCCUCAGGGGCCUA | 431 | 1969-1987 | A-148024 | UAGGCCCUGAGGACACUG | 616 | 1969-1987 |
| AD-73940 | A-148025 | GGGCCUGCCCAGUGCACUU | 432 | 1981-1999 | A-148026 | AAGUGCACUGGGCAGGCCC | 617 | 1981-1999 |
| AD-73941 | A-148027 | UGCACUGGCUGGAAGACGA | 433 | 1993-2011 | A-148028 | UCGUCUUCCAGCAAGUGCA | 618 | 1993-2011 |
| AD-73942 | A-148029 | UGGAAGACGCAAGGGCCUA | 434 | 2002-2020 | A-148030 | UAGGCCCUUGCGUCUUCCA | 619 | 2002-2020 |
| AD-73943 | A-148031 | AGGGCCUGAUGGGGUGGAA | 435 | 2013-2031 | A-148032 | UUCCACCCCAUCAGGCCCU | 620 | 2013-2031 |
| AD-73944 | A-148033 | GGGUGGAAGGCAUGGCGGA | 436 | 2024-2042 | A-148034 | UCCGCCAUGCCUUCCACCC | 621 | 2024-2042 |
| AD-73945 | A-148035 | UGGCCGGCCCCCAGCUGU | 437 | 2036-2054 | A-148036 | ACAGCUGGGGGGCCGCCA | 622 | 2036-2054 |
| AD-73946 | A-148037 | CAGCUGUCAUCAAUAAAG | 438 | 2048-2066 | A-148038 | CUUUAAUUGAUGACAGCUG | 623 | 2048-2066 |
| AD-73947 | A-148039 | AAUUAAAGGCAAAGGCAAU | 439 | 2059-2077 | A-148040 | AUUGCCUUUGCCUUUAAUU | 624 | 2059-2077 |
| AD-73948 | A-148041 | AAGGCAAUCGAAUCUAAAA | 440 | 2070-2088 | A-148042 | UUUUAGAUUCGAUUGCCUU | 625 | 2070-2088 |

TABLE 7

Human IGFALS Dual-Glo ® in vitro 10 nM screen

| Duplex Name | Average 10 nM | STDEV 10 nM |
|---|---|---|
| AD-73764 | 46.26 | 12.94 |
| AD-73765 | 15.98 | 9.39 |
| AD-73766 | 27.71 | 1.81 |
| AD-73767 | 29.96 | 5.64 |
| AD-73768 | 53.53 | 15.85 |
| AD-73769 | 50.94 | 18.08 |
| AD-73770 | 35.55 | 11.71 |
| AD-73771 | 30.07 | 11.32 |
| AD-73772 | 33.23 | 3.56 |
| AD-73773 | 11.46 | 4.14 |
| AD-73774 | 58.80 | 12.47 |
| AD-73775 | 108.20 | 18.60 |
| AD-73776 | 51.88 | 20.74 |
| AD-73777 | 30.64 | 7.39 |
| AD-73778 | 81.00 | 19.34 |
| AD-73779 | 78.23 | 16.91 |
| AD-73780 | 67.63 | 20.32 |
| AD-73781 | 75.04 | 41.97 |
| AD-73782 | 11.25 | 3.14 |
| AD-73783 | 84.25 | 27.48 |
| AD-73784 | 31.16 | 3.50 |
| AD-73785 | 40.36 | 15.91 |
| AD-73786 | 26.61 | 4.91 |
| AD-73787 | 37.73 | 13.41 |
| AD-73788 | 41.39 | 9.64 |
| AD-73789 | 69.70 | 17.02 |
| AD-73790 | 54.70 | 18.10 |
| AD-73791 | 37.77 | 14.31 |
| AD-73792 | 59.22 | 4.58 |
| AD-73793 | 30.72 | 11.33 |
| AD-73794 | 96.09 | 23.63 |
| AD-73795 | 27.15 | 4.14 |
| AD-73796 | 44.57 | 8.83 |
| AD-73797 | 22.69 | 5.07 |
| AD-73798 | 52.76 | 11.72 |
| AD-73799 | 69.71 | 10.21 |
| AD-73800 | 49.18 | 17.49 |
| AD-73801 | 59.80 | 17.00 |
| AD-73802 | 28.96 | 1.45 |
| AD-73803 | 33.13 | 19.76 |
| AD-73804 | 40.68 | 7.80 |
| AD-73805 | 63.69 | 6.82 |
| AD-73806 | 66.25 | 14.80 |
| AD-73807 | 48.62 | 17.85 |
| AD-73808 | 25.07 | 4.32 |
| AD-73809 | 68.40 | 17.86 |
| AD-73810 | 83.96 | 14.19 |
| AD-73811 | 64.13 | 17.42 |
| AD-73812 | 46.66 | 9.77 |
| AD-73813 | 44.50 | 17.35 |
| AD-73814 | 63.89 | 24.44 |
| AD-73815 | 52.18 | 19.16 |
| AD-73816 | 46.10 | 24.18 |
| AD-73817 | 47.24 | 12.69 |
| AD-73818 | 26.52 | 4.62 |
| AD-73819 | 48.75 | 11.37 |
| AD-73820 | 60.19 | 5.23 |
| AD-73821 | 94.35 | 26.80 |
| AD-73822 | 84.38 | 36.20 |
| AD-73823 | 40.82 | 16.47 |
| AD-73824 | 73.14 | 20.30 |
| AD-73825 | 28.56 | 4.59 |
| AD-73826 | 46.85 | 5.02 |
| AD-73827 | 47.58 | 13.90 |
| AD-73828 | 63.46 | 15.46 |
| AD-73829 | 95.35 | 32.53 |
| AD-73830 | 58.41 | 9.47 |
| AD-73831 | 76.16 | 9.56 |
| AD-73832 | 66.65 | 24.27 |
| AD-73833 | 48.53 | 16.86 |
| AD-73834 | 61.65 | 17.68 |
| AD-73835 | 58.15 | 28.49 |
| AD-73836 | 26.15 | 4.79 |
| AD-73837 | 43.30 | 9.38 |
| AD-73838 | 74.76 | 20.65 |
| AD-73839 | 78.85 | 7.72 |
| AD-73840 | 43.78 | 12.13 |
| AD-73841 | 40.30 | 13.20 |
| AD-73842 | 43.45 | 1.12 |
| AD-73843 | 47.08 | 8.45 |
| AD-73844 | 110.22 | 43.07 |
| AD-73845 | 53.10 | 20.78 |
| AD-73846 | 100.03 | 52.61 |
| AD-73847 | 59.82 | 19.09 |
| AD-73848 | 26.03 | 3.83 |
| AD-73849 | 38.45 | 7.00 |
| AD-73850 | 86.08 | 20.23 |
| AD-73851 | 61.41 | 7.67 |
| AD-73852 | 53.33 | 19.36 |
| AD-73853 | 85.67 | 29.83 |
| AD-73854 | 54.76 | 5.66 |
| AD-73855 | 104.89 | 36.39 |
| AD-73856 | 57.24 | 13.36 |
| AD-73857 | 63.18 | 12.14 |
| AD-73858 | 20.59 | 3.73 |
| AD-73859 | 42.26 | 7.68 |
| AD-73860 | 94.01 | 20.91 |
| AD-73861 | 45.90 | 18.39 |
| AD-73862 | 26.77 | 5.70 |
| AD-73863 | 39.07 | 19.21 |
| AD-73864 | 59.26 | 14.59 |
| AD-73865 | 41.82 | 10.07 |
| AD-73866 | 60.91 | 19.05 |
| AD-73867 | 35.80 | 9.83 |
| AD-73868 | 46.58 | 6.40 |
| AD-73869 | 64.22 | 11.51 |
| AD-73870 | 80.14 | 7.20 |
| AD-73871 | 60.16 | 20.80 |
| AD-73872 | 56.05 | 24.26 |
| AD-73873 | 68.99 | 18.51 |
| AD-73874 | 110.04 | 18.69 |
| AD-73875 | 45.34 | 19.36 |
| AD-73876 | 51.41 | 17.32 |
| AD-73877 | 48.52 | 10.40 |
| AD-73878 | 114.98 | 63.70 |
| AD-73879 | 60.09 | 8.24 |
| AD-73880 | 38.19 | 8.87 |
| AD-73881 | 74.45 | 6.60 |
| AD-73882 | 33.01 | 9.79 |
| AD-73883 | 34.58 | 16.31 |
| AD-73884 | 53.88 | 4.17 |
| AD-73885 | 40.86 | 12.23 |
| AD-73886 | 48.81 | 15.26 |
| AD-73887 | 100.05 | 43.02 |
| AD-73888 | 52.76 | 9.03 |
| AD-73889 | 104.07 | 24.09 |
| AD-73890 | 34.25 | 10.25 |
| AD-73891 | 59.05 | 17.53 |
| AD-73892 | 43.11 | 18.36 |
| AD-73893 | 74.85 | 51.34 |
| AD-73894 | 71.46 | 42.74 |
| AD-73895 | 67.51 | 15.16 |
| AD-73896 | 65.38 | 19.16 |
| AD-73897 | 113.90 | 19.73 |
| AD-73898 | 30.88 | 11.29 |
| AD-73899 | 71.21 | 20.59 |
| AD-73900 | 45.87 | 8.22 |
| AD-73901 | 81.14 | 27.00 |
| AD-73902 | 57.98 | 26.64 |
| AD-73903 | 60.87 | 50.48 |
| AD-73904 | 144.84 | 56.92 |
| AD-73905 | 80.06 | 7.93 |
| AD-73906 | 25.22 | 6.98 |
| AD-73907 | 33.52 | 8.04 |
| AD-73908 | 88.78 | 21.09 |
| AD-73909 | 94.23 | 19.36 |
| AD-73910 | 106.31 | 18.12 |
| AD-73911 | 64.23 | 4.10 |
| AD-73912 | 25.25 | 5.85 |
| AD-73913 | 42.38 | 3.07 |
| AD-73914 | 38.34 | 6.64 |
| AD-73915 | 61.19 | 28.72 |

TABLE 7-continued

| Human IGFALS Dual-Glo ® in vitro 10 nM screen | | |
|---|---|---|
| Duplex Name | Average 10 nM | STDEV 10 nM |
| AD-73916 | 71.86 | 28.39 |
| AD-73917 | 95.24 | 18.35 |
| AD-73918 | 80.25 | 27.23 |
| AD-73919 | 48.91 | 6.14 |
| AD-73920 | 39.40 | 11.01 |
| AD-73921 | 57.14 | 12.93 |
| AD-73922 | 45.90 | 21.00 |
| AD-73923 | 56.04 | 18.98 |
| AD-73924 | 28.94 | 7.49 |
| AD-73925 | 58.43 | 28.38 |
| AD-73926 | 102.32 | 34.13 |
| AD-73927 | 100.65 | 27.38 |
| AD-73928 | 85.51 | 11.58 |
| AD-73929 | 51.54 | 4.93 |
| AD-73930 | 27.83 | 6.80 |
| AD-73931 | 36.71 | 9.74 |
| AD-73932 | 37.09 | 6.54 |
| AD-73933 | 54.60 | 14.50 |
| AD-73934 | 188.17 | 65.46 |
| AD-73935 | 77.02 | 12.48 |
| AD-73936 | 71.96 | 24.59 |
| AD-73937 | 48.37 | 18.42 |
| AD-73938 | 47.06 | 6.65 |
| AD-73939 | 55.62 | 19.17 |
| AD-73940 | 74.83 | 6.45 |
| AD-73941 | 41.91 | 18.36 |
| AD-73942 | 87.02 | 43.38 |
| AD-73943 | 47.56 | 6.76 |
| AD-73944 | 39.62 | 7.36 |
| AD-73945 | 61.45 | 10.10 |
| AD-73946 | 16.22 | 4.18 |
| AD-73947 | 17.27 | 8.22 |
| AD-73948 | 33.62 | 7.51 |

TABLE 8

Modified Sense and Antisense Strand Sequences of IGFALS dsRNAs

| Duplex Name | Sense Oligo Name | Sense Oligo Sequence | SEQ ID | Antisense Oligo Name | Antisense Oligo Seq | SEQ ID | mRNA target sequence | SEQ ID |
|---|---|---|---|---|---|---|---|---|
| AD-73764 | A-147667 | AGGGCAGGGGUGGCCCGGCAdTdT | 626 | A-147668 | UGCCGGCCACCCCUGCCCUdTdT | 811 | AGGGCAGGGGUGGCCCGGCA | 996 |
| AD-73765 | A-147669 | CCGGCACAGCAGACGUACAdTdT | 627 | A-147670 | UGUACGUCUGCUGUGCCGGdTdT | 812 | CCGGCACAGCAGACGUACC | 997 |
| AD-73766 | A-147671 | AGACGUACCCCUCCCCUdTdT | 628 | A-147672 | AGCGAGGGAGGGUACCGUCUdTdT | 813 | AGACGUACCCCUCCCCUGCU | 998 |
| AD-73767 | A-147673 | UCCCCUCGCUGCCUGAdTdT | 629 | A-147674 | UCAGGGCAGGCAGCGAGGGAdTdT | 814 | UCCCCUCGCUGCCUGCCUGC | 999 |
| AD-73768 | A-147675 | UGCCUGCAGCCUGCCUGAdTdT | 630 | A-147676 | UCAGGGCAGGCUGCAGGCAdTdT | 815 | UGCCUGCAGCCUGCCUGC | 1000 |
| AD-73769 | A-147677 | UGCCCUGCAUGCAGGAUGAdTdT | 631 | A-147678 | UCAUCCUGCAUGCAGGGCAdTdT | 816 | UGCCCUGCAUGCAGGAUGG | 1001 |
| AD-73770 | A-147679 | AGGAUGGCCCUGAGGAAAGdTdT | 632 | A-147680 | CUUUCCUCAGGGCCAUCCUdTdT | 817 | AGGAUGGCCCUGAGGAAAG | 1002 |
| AD-73771 | A-147681 | CUGAGGAAAGGAGGCCUGAdTdT | 633 | A-147682 | UCAGGCCUCCUUUCCUCAGdTdT | 818 | CUGAGGAAAGGAGGCCUGG | 1003 |
| AD-73772 | A-147683 | AGGCCUGGCCUGGGCGCUAdTdT | 634 | A-147684 | UAGCGCCAGGGCCAGGCCUdTdT | 819 | AGGCCUGGCCUGGGCGCUG | 1004 |
| AD-73773 | A-147685 | GCGCUGGCUGCUGUCCCUdTdT | 635 | A-147686 | AGGACAGCAGCAGCAGCGCdTdT | 820 | GCGCUGGCUGCUGUCCCU | 1005 |
| AD-73774 | A-147687 | UGCUGUCCUGGGGUGGCACUdTdT | 636 | A-147688 | AGUGCCACCCAGGACAGCAdTdT | 821 | UGCUGUCCUGGGGUGGCACU | 1006 |
| AD-73775 | A-147689 | UGGCACUGGGCCCCCCAAdTdT | 637 | A-147690 | UUGCGGGGGCCCAGUGCCAdTdT | 822 | UGGCACUGGGCCCCCCCAG | 1007 |
| AD-73776 | A-147691 | GCCCCCAGCCUGAGGAGGAdTdT | 638 | A-147692 | UCCUCCAGGCUGGGGGCdTdT | 823 | GCCCCCAGCCUGGAGGG | 1008 |
| AD-73777 | A-147693 | UGGAGGGAGCAGACCCCGAdTdT | 639 | A-147694 | UCGGGGUCUGCUCCUCCAdTdT | 824 | UGGAGGGAGCAGACCCCGG | 1009 |
| AD-73778 | A-147695 | AGACCCCGGAACGCCGGGAdTdT | 640 | A-147696 | UCCCGGCGUUCCGGGGUCUdTdT | 825 | AGACCCCGGAACGCCGGGG | 1010 |
| AD-73779 | A-147697 | CGCCGGGAAGCCGAGGGdTdT | 641 | A-147698 | UCCUCGGCUUCCCCGGCGdTdT | 826 | CGCCGGGGAAGCCGAGGG | 1011 |
| AD-73780 | A-147699 | CGAGGGCCCAGCGUGCCCAdTdT | 642 | A-147700 | UGGGCACGCUGGGCCCUCGdTdT | 827 | CGAGGGCCCAGCGUGCCCG | 1012 |
| AD-73781 | A-147701 | AGCGUGCCCGGCCGCCUGUdTdT | 643 | A-147702 | ACAGGGCGGCCGGGCACGCUdTdT | 828 | AGCGUGCCCGGCCGCCUGU | 1013 |
| AD-73782 | A-147703 | GCCGUGUACGAUGACGAdTdT | 644 | A-147704 | UGUAGCUGCAGACACAGGCdTdT | 829 | GCCGUGUACGAUGACG | 1014 |
| AD-73783 | A-147705 | UGCAGCUACGAUGACGACAdTdT | 645 | A-147706 | UGUCGUCAUCGUAGCUGCAdTdT | 830 | UGCAGCUACGAUGACGACG | 1015 |
| AD-73784 | A-147707 | GACGACGCGGAUGAGAGCUCAdTdT | 646 | A-147708 | UGAGCUCUCGCCGUCGUCdTdT | 831 | GACGACGCGGAUGAGAGCUCA | 1016 |
| AD-73785 | A-147709 | AUGAGCUCAGCGCUCUUCUdTdT | 647 | A-147710 | UAGAAGAGCGCUGAGCUCAUdTdT | 832 | AUGAGCUCAGCGCUCUUCUG | 1017 |
| AD-73786 | A-147711 | UCUUCUGCAGCUCCAGGAAdTdT | 648 | A-147712 | UUCCUGGAGCUGCAGAAGAdTdT | 833 | UCUUCUGCAGCUCCAGGAA | 1018 |

TABLE 8-continued

Modified Sense and Antisense Strand Sequences of IGFALS dsRNAs

| Duplex Name | Sense Oligo Name | Sense Oligo Sequence | SEQ ID | Antisense Oligo Name | Antisense Oligo Seq | SEQ ID | mRNA target sequence | SEQ ID |
|---|---|---|---|---|---|---|---|---|
| AD-73787 | A-147713 | UCCAGGAACCUCACGCGCAdTdT | 649 | A-147714 | UGCGCGUGAGGUUCUGGAdTdT | 834 | UCCAGGAACCUCACGCGCC | 1019 |
| AD-73788 | A-147715 | UCACGCGCCUGCCUGAUGAdTdT | 650 | A-147716 | UCAUCAGGCAGGCGCCUGAdTdT | 835 | UCACGCGCCUGCCUGAUGG | 1020 |
| AD-73789 | A-147717 | UGAUGGAGUCCCGGCGGAdTdT | 651 | A-147718 | UCCGCCCGGGACUCCAUCAdTdT | 836 | UGAUGGAGUCCCGGCGGGC | 1021 |
| AD-73790 | A-147719 | CGGGCGGCACCCAAGCCCUdTdT | 652 | A-147720 | AGGGCUGGGUGCCGCCCGdTdT | 837 | CGGGCGGCACCCAAGCCCU | 1022 |
| AD-73791 | A-147721 | CAAGCCCUGUGGCUGGACGdTdT | 653 | A-147722 | UGUCCAGCCACAGGGCUUGdTdT | 838 | CAAGCCCUGUGGCUGGACG | 1023 |
| AD-73792 | A-147723 | UGGCUGGACGCGCAACAACAdTdT | 654 | A-147724 | UGUUGUUGCCGCAGUCCAGdTdT | 839 | UGGCUGGACGCGCAACAACC | 1024 |
| AD-73793 | A-147725 | AACAACUCUCGUCCUCAdTdT | 655 | A-147726 | UGACGGACGAGAGGUUGUUdTdT | 840 | AACAACUCUCGUCCUCC | 1025 |
| AD-73794 | A-147727 | UCCGUCCCCCCGGCAGCCUdTdT | 656 | A-147728 | AGGCUGCCGGGGGGACGGAdTdT | 841 | UCCGUCCCCCCGGCAGCCU | 1026 |
| AD-73795 | A-147729 | CGGCAGCCUUCCAGAACCUdTdT | 657 | A-147730 | AGGUUCUGGAAGGCUGCCGdTdT | 842 | CGGCAGCCUUCCAGAACCU | 1027 |
| AD-73796 | A-147731 | CAGAACCUCUCCAGCCUGAdTdT | 658 | A-147732 | UCAGGCUGGAGAGGUUCUGdTdT | 843 | CAGAACCUCUCCAGCCUGG | 1028 |
| AD-73797 | A-147733 | AGCCUGGGCUUCCUCAACAdTdT | 659 | A-147734 | UGUUGAGGAAGCCCAGGCUdTdT | 844 | AGCCUGGGCUUCCUCAACC | 1029 |
| AD-73798 | A-147735 | UUCCUCAACCUGCAGGGCAdTdT | 660 | A-147736 | UGCCCUGCAGGUUGAGGAAdTdT | 845 | UUCCUCAACCUGCAGGGCG | 1030 |
| AD-73799 | A-147737 | CAGGGCGGCCAGCUGGCAdTdT | 661 | A-147738 | UGCCCAGCUGGCCGCCCUGdTdT | 846 | CAGGGCGGCCAGCUGGGCA | 1031 |
| AD-73800 | A-147739 | AGCUGGGCAGCCUGGAGCCUdTdT | 662 | A-147740 | UGCUCCAGGCUGCCCAGCUdTdT | 847 | AGCUGGGCAGCCUGGAGCC | 1032 |
| AD-73801 | A-147741 | CUGGAGCCACAGGCGCUGCdTdT | 663 | A-147742 | UCAGCGCCUGUGGCUCCAGdTdT | 848 | CUGGAGCCACAGGCGCUGC | 1033 |
| AD-73802 | A-147743 | CGCUGCUGGGCCUAGAGAAdTdT | 664 | A-147744 | UUCUCUAGGCCCAGCAGCGdTdT | 849 | CGCUGCUGGGCCUAGAGAA | 1034 |
| AD-73803 | A-147745 | CUAGAGAACCUGUGCCACAdTdT | 665 | A-147746 | UGUGGCACAGGUUCUCUAGdTdT | 850 | CUAGAGAACCUGUGCCACC | 1035 |
| AD-73804 | A-147747 | UGUGCCACCUGCACCUGGAdTdT | 666 | A-147748 | UCCAGGUGCAGGUGGCACAdTdT | 851 | UGUGCCACCUGCACCUGGA | 1036 |
| AD-73805 | A-147749 | ACCUGGAGCGGAACCAGCUdTdT | 667 | A-147750 | AGCUGGUUCCGCUCCAGGUdTdT | 852 | ACCUGGAGCGGAACCAGCU | 1037 |
| AD-73806 | A-147751 | AACCAGCUGCGCAGCCUGGdTdT | 668 | A-147752 | UCAGGCUGCGCAGCUGGUUdTdT | 853 | AACCAGCUGCGCAGCCUGG | 1038 |
| AD-73807 | A-147753 | CGCAGCCUGGCACUCGGCAdTdT | 669 | A-147754 | UGCCGAGUGCCAGGCUGCGdTdT | 854 | CGCAGCCUGGCACUCGGCA | 1039 |
| AD-73808 | A-147755 | UCGGGCACGUUUGCACACAdTdT | 670 | A-147756 | UUGUGUGCAAACGUGCCGAdTdT | 855 | UCGGGCACGUUUGCACACAC | 1040 |
| AD-73809 | A-147757 | UUGCACACACCCCCGCGCUdTdT | 671 | A-147758 | AGCGCGGGGGUGUGUGCAAdTdT | 856 | UUGCACACACCCCCGCGCU | 1041 |

TABLE 8-continued

Modified Sense and Antisense Strand Sequences of IGFALS dsRNAs

| Duplex Name | Sense Oligo Name | Sense Oligo Sequence | SEQ ID | Antisense Oligo Name | Antisense Oligo Seq | SEQ ID | mRNA target sequence | SEQ ID |
|---|---|---|---|---|---|---|---|---|
| AD-73810 | A-147759 | CCCGCGCUGGCCUCGCUCAdTdT | 672 | A-147760 | UGAGCGAGGCCAGCGCGGGdTdT | 857 | CCCGCGCUGGCCUCGCUCG | 1042 |
| AD-73811 | A-147761 | UCGCUCGGCCUCAGCAACAdTdT | 673 | A-147762 | UGUUGCUGAGGCCGAGCGAdTdT | 858 | UCGCUCGGCCUCAGCAACA | 1043 |
| AD-73812 | A-147763 | AGCAACAACCGUCUGAGCAdTdT | 674 | A-147764 | UGCUCAGACGGUUGUUGCUdTdT | 859 | AGCAACAACCGUCUGAGCA | 1044 |
| AD-73813 | A-147767 | CUGGAGGACGGGCUCUUCAdTdT | 675 | A-147768 | UGAAGAGCCCGUCCUCCAGdTdT | 860 | CUGGAGGACGGGCUCUUCG | 1045 |
| AD-73814 | A-147769 | CUCUUCGAGGGCCUCGGCAdTdT | 676 | A-147770 | UGCCGAGGCCCUCGAAGAGdTdT | 861 | CUCUUCGAGGGCCUCGGCA | 1046 |
| AD-73815 | A-147771 | GGCCUCGGCAGCCUCUGGGdTdT | 677 | A-147772 | UCCAGAGGCUGCCGAGGCCdTdT | 862 | GGCCUCGGCAGCCUCUGGG | 1047 |
| AD-73816 | A-147773 | UCUGGGACCUCAACCUCGGdTdT | 678 | A-147774 | UCGAGGUUGAGGUCCCAGAdTdT | 863 | UCUGGGACCUCAACCUCGG | 1048 |
| AD-73817 | A-147775 | AACCUCGGCUGGAAUAGCCdTdT | 679 | A-147776 | UGCUAUUCCAGCCGAGGUUdTdT | 864 | AACCUCGGCUGGAAUAGCC | 1049 |
| AD-73818 | A-147777 | UGGAAUAGCCUGGCCGUGAdTdT | 680 | A-147778 | UCACCGCCAGGCUAUUCCAdTdT | 865 | UGGAAUAGCCUGGCCGUGC | 1050 |
| AD-73819 | A-147779 | CGGUGCUCCCCGAUGCGGCdTdT | 681 | A-147780 | UCCGCAUCGGGGAGCACCGdTdT | 866 | CGGUGCUCCCCGAUGCGGC | 1051 |
| AD-73820 | A-147781 | GAUGCGGCGCGUUCCGGCCdTdT | 682 | A-147782 | UGCUCCGGAACGCCGCCAUdTdT | 867 | GAUGCGGCGCGUUCCGGCC | 1052 |
| AD-73821 | A-147783 | UUCCGCGGCCUGGGCAGCCdTdT | 683 | A-147784 | UGCUGCCCAGGCCGCGGAAdTdT | 868 | UUCCGCGGCCUGGGCAGCC | 1053 |
| AD-73822 | A-147785 | GCAGCCUGCGCGAGCUGGUdTdT | 684 | A-147786 | ACCAGCUCGCGCAGGCUGCdTdT | 869 | GCAGCCUGCGCGAGCUGGU | 1054 |
| AD-73823 | A-147787 | GAGCUGGUGCUGGCGGGCAdTdT | 685 | A-147788 | UGCCCGCCAGCACCAGCUCdTdT | 870 | GAGCUGGUGCUGGCGGGCA | 1055 |
| AD-73824 | A-147789 | CUGGGCAACAGGCUGAGGdTdT | 686 | A-147790 | UCAGCCUGUUGCCCAGCUGdTdT | 871 | CUGGGCAACAGGCUGAGG | 1056 |
| AD-73825 | A-147791 | AGGCUGGCCUACCUGCAGCdTdT | 687 | A-147792 | UCUGCAGGUAGGCCAGCCUdTdT | 872 | AGGCUGGCCUACCUGCAGC | 1057 |
| AD-73826 | A-147793 | ACCUGCAGCCCCGCGCUCUUdTdT | 688 | A-147794 | AAGAGCGCGGGGCUGCAGGUdTdT | 873 | ACCUGCAGCCCCGCGCUCUU | 1058 |
| AD-73827 | A-147795 | CGCUCUUCAGCGGCCUGGCdTdT | 689 | A-147796 | UCCAGGCCGCUGAAGAGCGdTdT | 874 | CGCUCUUCAGCGGCCUGGC | 1059 |
| AD-73828 | A-147797 | CGGGCCUGGCCCGAGCUCCdTdT | 690 | A-147798 | UCGGAGCUCGGCCAGGCCGdTdT | 875 | CGGCCUGGCCGAGCUCCGG | 1060 |
| AD-73829 | A-147799 | AGUCCGGGAGCUGGACCUdTdT | 691 | A-147800 | AGGUCCAGCUCCCGGACUdTdT | 876 | AGUCCGGGAGCUGGACCUU | 1061 |
| AD-73830 | A-147801 | CUGGACCUGAGCAGGAACAdTdT | 692 | A-147802 | UGUUCCUGCUCAGGUCCAGdTdT | 877 | CUGGACCUGAGCAGGAACG | 1062 |
| AD-73831 | A-147803 | AGGAACGCGUCGCGGCCAdTdT | 693 | A-147804 | UGGCCCCGCAGCGCGUUCCUdTdT | 878 | AGGAACGCGUCGCGGCCA | 1063 |
| AD-73832 | A-147805 | CGGGCCAUCAAGGCAAACGdTdT | 694 | A-147806 | UGUUUGCCUUGAUGGCCCGdTdT | 879 | CGGGCCAUCAAGGCAAACG | 1064 |
| AD-73833 | A-147807 | AAGGCAAACGUGUUCGUGAdTdT | 695 | A-147808 | UCACGAACACGUUUGCCUUdTdT | 880 | AAGGCAAACGUGUUCGUGC | 1065 |

TABLE 8-continued

Modified Sense and Antisense Strand Sequences of IGFALS dsRNAs

| Duplex Name | Sense Oligo Name | Sense Oligo Sequence | SEQ ID | Antisense Oligo Name | Antisense Oligo Seq | SEQ ID | mRNA target sequence | SEQ ID |
|---|---|---|---|---|---|---|---|---|
| AD-73834 | A-147809 | UUCGUGCAGCUGCCCCGGAdTdT | 696 | A-147810 | UCCGGGGCAGCUGCACGAAdTdT | 881 | UUCGUGCAGCUGCCCCGGC | 1066 |
| AD-73835 | A-147813 | AGAAACUCUACCUGGACCAdTdT | 697 | A-147814 | UGGUCCAGGUAGAGUUUCUdTdT | 882 | AGAAACUCUACCUGGACCG | 1067 |
| AD-73836 | A-147815 | CCUGACCGCAACCUCAUAdTdT | 698 | A-147816 | UAUGAGGUUGCGGUCCAGGdTdT | 883 | CCUGACCGCAACCUCAUC | 1068 |
| AD-73837 | A-147817 | CCUCAUCGCUGCCGUGGCAdTdT | 699 | A-147818 | UGCCACGGCAGCGAUGAGGdTdT | 884 | CCUCAUCGCUGCCGUGGCC | 1069 |
| AD-73838 | A-147819 | CGUGGCCCCGGGCGCCUUAdTdT | 700 | A-147820 | UAAGGCGCCCGGGGCCACGdTdT | 885 | CGUGGCCCCGGGCGCCUUC | 1070 |
| AD-73839 | A-147821 | GGCGCCUUCUGGGCCUGAdTdT | 701 | A-147822 | UCAGGCCCAGAAGGCGCCdTdT | 886 | GGCGCCUUCUGGGCCUGA | 1071 |
| AD-73840 | A-147823 | UGGGCCUGAAGGCGCUGCAdTdT | 702 | A-147824 | UGCAGCGCCUUCAGGCCCAdTdT | 887 | UGGGCCUGAAGGCGCUGCG | 1072 |
| AD-73841 | A-147825 | CGCUGCGAUGGCUGGACCUdTdT | 703 | A-147826 | AGGUCCAGCCAUCGCAGCGdTdT | 888 | CGCUGCGAUGGCUGGACCU | 1073 |
| AD-73842 | A-147827 | UGGACCUGUCCCACAACCAdTdT | 704 | A-147828 | UGGUUGUGGGACAGGUCCAdTdT | 889 | UGGACCUGUCCCACAACCG | 1074 |
| AD-73843 | A-147829 | CACAACCGCGUGGCUGGCAdTdT | 705 | A-147830 | UGCCAGCCACGCGGUUGUGdTdT | 890 | CACAACCGCGUGGCUGGCC | 1075 |
| AD-73844 | A-147831 | UGGCUGGCCUCCUGGAGGAdTdT | 706 | A-147832 | UCCUCCAGGAGGCCAGCCAdTdT | 891 | UGGCUGGCCUCCUGGAGGA | 1076 |
| AD-73845 | A-147833 | CCUGGAGGACGUCCCCAdTdT | 707 | A-147834 | UGGGAACGUCCUCCAGGdTdT | 892 | CCUGGAGGACGUCCCCC | 1077 |
| AD-73846 | A-147835 | UUCCCGGUCUGCUGGCCAdTdT | 708 | A-147836 | UGCCCAGCAGACCGGGAAdTdT | 893 | UUCCCGGUCUGCUGGGCC | 1078 |
| AD-73847 | A-147837 | UGCUGGGCCUGCGCUGUGCUdTdT | 709 | A-147838 | AGCACACGCAGGCCCAGCAdTdT | 894 | UGCUGGGCCUGCGCUGUGCU | 1079 |
| AD-73848 | A-147839 | CGUGUGCUGCCGGCUGUCCAdTdT | 710 | A-147840 | UGGACAGCCGCAGCACACGdTdT | 895 | CGUGUGCUGCCGGCUGUCCC | 1080 |
| AD-73849 | A-147841 | CUGUCCACAACGCCAUCAdTdT | 711 | A-147842 | UGAUGGCGUUGUGGACAGdTdT | 896 | CUGUCCACAACGCCAUCG | 1081 |
| AD-73850 | A-147843 | AACGCCAUCGCCAGCCUGCdTdT | 712 | A-147844 | UCAGGCUGGCGAUGGCGUUdTdT | 897 | AACGCCAUCGCCAGCCUGC | 1082 |
| AD-73851 | A-147845 | AGCCUGCGGGCCCCGACCUdTdT | 713 | A-147846 | AGGUCGGGGCCCGCAGGCUdTdT | 898 | AGCCUGCGGGCCCCGACCU | 1083 |
| AD-73852 | A-147847 | CGCACCUUCAAGGACCUGAdTdT | 714 | A-147848 | UCAGGUCCUUGAAGGUGCGdTdT | 899 | CGCACCUUCAAGGACCUGC | 1084 |
| AD-73853 | A-147849 | AAGGACCUGCACUUCCUGAdTdT | 715 | A-147850 | UCAGGAAGUGCAGGUCCUUdTdT | 900 | AAGGACCUGCACUUCCUGG | 1085 |
| AD-73854 | A-147851 | UUCCUGGAGGAGCUGCAGAdTdT | 716 | A-147852 | UCUGCAGCUCCUCCAGGAAdTdT | 901 | UUCCUGGAGGAGCUGCAGC | 1086 |
| AD-73855 | A-147853 | CUGCAGCUGGGCCCACAACAdTdT | 717 | A-147854 | UGUUGUGGGCCCAGCUGCAGdTdT | 902 | CUGCAGCUGGGCCACAACC | 1087 |
| AD-73856 | A-147855 | CCAACAACCGCAUCCGGAAdTdT | 718 | A-147856 | UUGCCCGAUGCGGUUGUGGdTdT | 903 | CCACAACCGCAUCCGGCAG | 1088 |

TABLE 8-continued

Modified Sense and Antisense Strand Sequences of IGFALS dsRNAs

| Duplex Name | Sense Oligo Name | Sense Oligo Sequence | SEQ ID | Antisense Oligo Name | Antisense Oligo Seq | SEQ ID | mRNA target sequence | SEQ ID |
|---|---|---|---|---|---|---|---|---|
| AD-73857 | A-147857 | UCCGGCAGCUGGCUGAGCAdTdT | 719 | A-147858 | UGCUCAGCCAGCUGCCGGAdTdT | 904 | UCCGGCAGCUGGCUGAGCG | 1089 |
| AD-73858 | A-147859 | UGGCUGAGCGCAGCUUUGAdTdT | 720 | A-147860 | UCAAAGCUGCCUCAGCCAdTdT | 905 | UGGCUGAGCGCAGCUUUGA | 1090 |
| AD-73859 | A-147861 | AGCUUUGAGGGCCUGGGGAdTdT | 721 | A-147862 | UCCCCAGGCCCUCAAAGCUdTdT | 906 | AGCUUUGAGGGCCUGGGGC | 1091 |
| AD-73860 | A-147863 | UGGGGCAGCUUGAGGUGCUdTdT | 722 | A-147864 | AGCACCUCAAGCUGCCCCAdTdT | 907 | UGGGGCAGCUUGAGGUGCU | 1092 |
| AD-73861 | A-147865 | UUGAGGUGCUCACGCUAGAdTdT | 723 | A-147866 | UCUAGCGUGAGCACCUCAAdTdT | 908 | UUGAGGUGCUCACGCUAGA | 1093 |
| AD-73862 | A-147867 | ACGCUAGACCACAACCAGCdTdT | 724 | A-147868 | UCUGGUUGUGGUCUAGCGUdTdT | 909 | ACGCUAGACCACAACCAGC | 1094 |
| AD-73863 | A-147869 | AACCAGCUCCAGGAGGUCAdTdT | 725 | A-147870 | UGACCUCCUGGAGCUGGUUdTdT | 910 | AACCAGCUCCAGGAGGUCA | 1095 |
| AD-73864 | A-147871 | AGGAGGUCAAGGCGGGCGAdTdT | 726 | A-147872 | UCGCCCGCCUUGACCUCCUdTdT | 911 | AGGAGGUCAAGGCGGGCGC | 1096 |
| AD-73865 | A-147873 | CGGGCGCUUUCCUCGGCCUdTdT | 727 | A-147874 | AGGCCGAGGAAAGCGCCCGdTdT | 912 | CGGGCGCUUUCCUCGGCCU | 1097 |
| AD-73866 | A-147875 | CUCGGCCUCACCAACGUGAdTdT | 728 | A-147876 | UCACGUUGGUGAGGCCGAGdTdT | 913 | CUCGGCCUCACCAACGUGG | 1098 |
| AD-73867 | A-147877 | AACGUGGCGGUCAUGAACAdTdT | 729 | A-147878 | UGUUCAUGACCGCCACGUUdTdT | 914 | AACGUGGCGGUCAUGAACC | 1099 |
| AD-73868 | A-147879 | UCAUGAACCUCUCUGGAAdTdT | 730 | A-147880 | UUCCAGAGAGGUUCAUGAdTdT | 915 | UCAUGAACCUCUCUGGGAA | 1100 |
| AD-73869 | A-147881 | UCUGGGAACUGUCUCCGGAdTdT | 731 | A-147882 | UCCGGAGACAGUUCCCAGAdTdT | 916 | UCUGGGAACUGUCUCCGGA | 1101 |
| AD-73870 | A-147883 | UCUCCGGAACCUUCCCAGAdTdT | 732 | A-147884 | UCUGGGAAGGUUCCGGAGAdTdT | 917 | UCUCCGGAACCUUCCCGAG | 1102 |
| AD-73871 | A-147885 | UUCCGGAGCAGGUGUUCCGdTdT | 733 | A-147886 | UGGAACACCUGCUCCCGGAAdTdT | 918 | UUCCGGAGCAGGUGUUCCG | 1103 |
| AD-73872 | A-147887 | GGUGUUCCGGGGCCUGGGCdTdT | 734 | A-147888 | UCCCAGGCCCCGGAACACCdTdT | 919 | GGUGUUCCGGGGCCUGGGC | 1104 |
| AD-73873 | A-147889 | CUGGGCAAGCUGCCACAGCCdTdT | 735 | A-147890 | UGCUGUGCAGCUUGCCCAGdTdT | 920 | CUGGGCAAGCUGCCACAGCC | 1105 |
| AD-73874 | A-147891 | UGCACAGCCUGCCACCUGGAdTdT | 736 | A-147892 | UCCAGGUGCAGGCUGUGCAdTdT | 921 | UGCACAGCCUGCCACCUGGA | 1106 |
| AD-73875 | A-147895 | CAGCUGCCUGGGACGCAUCdTdT | 737 | A-147896 | UAUGCGUCCCAGGCAGCUGdTdT | 922 | CAGCUGCCUGGGACGCAUC | 1107 |
| AD-73876 | A-147897 | GACGCAUCCGCCCGCACAAdTdT | 738 | A-147898 | UUGUGCGGGCGGAUGCGUCdTdT | 923 | GACGCAUCCGCCCGCACAC | 1108 |
| AD-73877 | A-147899 | CGCACACCUUCACCGGCCUdTdT | 739 | A-147900 | AGGCCGGUGAAGGUGUGCGdTdT | 924 | CGCACACCUUCACCGGCCU | 1109 |
| AD-73878 | A-147901 | UCACCGGCCUCUCGGGGCUdTdT | 740 | A-147902 | AGCCCCGAGAGGCCGGUGAdTdT | 925 | UCACCGGCCUCUCGGGGCU | 1110 |
| AD-73879 | A-147903 | UCGGGGCUCCGCCGACUCUdTdT | 741 | A-147904 | AGAGUCGGCGGAGCCCCGAdTdT | 926 | UCGGGGCUCCGCCGACUCU | 1111 |
| AD-73880 | A-147905 | CGACUCUUCCUCAAGGACAdTdT | 742 | A-147906 | UGUCCUUGAGGAAGAGUCGdTdT | 927 | CGACUCUUCCUCAAGGACA | 1112 |

TABLE 8-continued

Modified Sense and Antisense Strand Sequences of IGFALS dsRNAs

| Duplex Name | Sense Oligo Name | Sense Oligo Sequence | SEQ ID | Antisense Oligo Name | Antisense Oligo Seq | SEQ ID | mRNA target sequence | SEQ ID |
|---|---|---|---|---|---|---|---|---|
| AD-73881 | A-147907 | CAAGGACAACGGCCUCGUAdTdT | 743 | A-147908 | UACGAGGCCGUUGUCCUUGdTdT | 928 | CAAGGACAACGGCCUCGUG | 1113 |
| AD-73882 | A-147909 | GGCCUCGUGGGCAUUGAGAdTdT | 744 | A-147910 | UCUCAAUGCCCACGAGGCCdTdT | 929 | GGCCUCGUGGGCAUUGAGG | 1114 |
| AD-73883 | A-147911 | UUGAGGAGCAGAGCCUGUAdTdT | 745 | A-147912 | UACAGGCUCUGCUCUCAAdTdT | 930 | UUGAGGAGCAGAGCCUGUG | 1115 |
| AD-73884 | A-147913 | AGAGCCUGUGGGGGCUGGAdTdT | 746 | A-147914 | UCCAGCCCCACAGGCUCUdTdT | 931 | AGAGCCUGUGGGGGCUGGC | 1116 |
| AD-73885 | A-147915 | GGGCUGGCGAGCUGCUGAdTdT | 747 | A-147916 | UCAGCAGCUCCGCCAGCCCdTdT | 932 | GGGCUGGCGGAGCUGCUGG | 1117 |
| AD-73886 | A-147917 | UGCUGGAGCUCGACCUGAAdTdT | 748 | A-147918 | UUCAGGUCGAGCUCCAGCAdTdT | 933 | UGCUGGAGCUCGACCUGAC | 1118 |
| AD-73887 | A-147919 | GACCUGACCUCCAACCAGAdTdT | 749 | A-147920 | UCUGGUUGGAGGUCAGGUCdTdT | 934 | GACCUGACCUCCAACCAGC | 1119 |
| AD-73888 | A-147921 | UCCAACCAGCUCACGCACAdTdT | 750 | A-147922 | UGUGCGUGAGCUGGUUGGAdTdT | 935 | UCCAACCAGCUCACGCACC | 1120 |
| AD-73889 | A-147923 | ACGCACCAGCCUGCCCACCdTdT | 751 | A-147924 | UGCGGGUGGGCAGGCUGUdTdT | 936 | ACGCACCAGCCUGCCCACC | 1121 |
| AD-73890 | A-147925 | CACCGCCUCUUCCAGGGCAdTdT | 752 | A-147926 | UGCCCUGGAAGAGGCGGUGdTdT | 937 | CACCGCCUCUUCCAGGGCC | 1122 |
| AD-73891 | A-147927 | UCCAGGGCCUGGGCAAGCUdTdT | 753 | A-147928 | AGCUUGCCCAGGCCCUGGAdTdT | 938 | UCCAGGGCCUGGGCAAGCU | 1123 |
| AD-73892 | A-147929 | GCAAGCUGGAGUACUCGCUdTdT | 754 | A-147930 | AGCAGUACUCCAGCUUGCdTdT | 939 | GCAAGCUGGAGUACUCGCU | 1124 |
| AD-73893 | A-147931 | UACCUGCUGCUCUCCCGCAdTdT | 755 | A-147932 | UGCGGGAGAGCAGCAGGUAdTdT | 940 | UACCUGCUGCUCUCCCGCA | 1125 |
| AD-73894 | A-147933 | CUCUCCCGCAACCGCCUGGdTdT | 756 | A-147934 | UCAGGCGGUUGCGGGAGAGdTdT | 941 | CUCUCCCGCAACCGCCUGG | 1126 |
| AD-73895 | A-147935 | CCGCCUGGCAGAGCUGCCGdTdT | 757 | A-147936 | UGGCAGCUCUGCCAGGCGGdTdT | 942 | CCGCCUGGCAGAGCUGCCG | 1127 |
| AD-73896 | A-147937 | AGCUGCCGGCGGACGCCCUdTdT | 758 | A-147938 | AGGGCGUCCGCCGGCAGCUdTdT | 943 | AGCUGCCGGCGGACGCCCU | 1128 |
| AD-73897 | A-147939 | GACGCCCUGGGCCCCCUGCdTdT | 759 | A-147940 | UCAGGGGGCCCAGGGCGUCdTdT | 944 | GACGCCCUGGGCCCCCUGC | 1129 |
| AD-73898 | A-147941 | CCCCUGCAGCGGGCCUUCUdTdT | 760 | A-147942 | AGAAGGCCCGCUGCAGGGGdTdT | 945 | CCCCUGCAGCGGGCCUUCU | 1130 |
| AD-73899 | A-147943 | GGGCCUUCUGGCUGGACGUdTdT | 761 | A-147944 | ACGUCCAGCCAGAAGGCCCdTdT | 946 | GGGCCUUCUGGCUGGACGU | 1131 |
| AD-73900 | A-147945 | UGGACGUCUCGCACAACCGdTdT | 762 | A-147946 | UGGUUGUGCGAGACGUCCAdTdT | 947 | UGGACGUCUCGCACAACCG | 1132 |
| AD-73901 | A-147947 | ACAACCGCCUGGAGGCAUUdTdT | 763 | A-147948 | AAUGCCUCCAGGCGGUUGUdTdT | 948 | ACAACCGCCUGGAGGCAUU | 1133 |
| AD-73902 | A-147949 | GAGGCAUUGCCCAACAGCCdTdT | 764 | A-147950 | UGCUGUUGGGCAAUGCCUCdTdT | 949 | GAGGCAUUGCCCAACAGCC | 1134 |
| AD-73903 | A-147951 | CAACAGCCUCUUGGCCACCAdTdT | 765 | A-147952 | UGGUGCCAAGAGGCUGUUGdTdT | 950 | CAACAGCCUCUUGGCCACCA | 1135 |

TABLE 8-continued

Modified Sense and Antisense Strand Sequences of IGFALS dsRNAs

| Duplex Name | Sense Oligo Name | Sense Oligo Sequence | SEQ ID | Antisense Oligo Name | Antisense Oligo Seq | SEQ ID | mRNA target sequence | SEQ ID |
|---|---|---|---|---|---|---|---|---|
| AD-73904 | A-147953 | UUGGCACCACUGGGGCGGAdTdT | 766 | A-147954 | UCCGCCCCAGUGGUGCCAAdTdT | 951 | UUGGCACCACUGGGGCGGC | 1136 |
| AD-73905 | A-147955 | UGGGGCGGCUGCGCUACCUdTdT | 767 | A-147956 | AGGUAGCGCAGCCGCCCCAdTdT | 952 | UGGGGCGGCUGCGCUACCU | 1137 |
| AD-73906 | A-147957 | CGCUACCUCAGCCUCAGGAdTdT | 768 | A-147958 | UCCUGAGGCUGAGGUAGCGdTdT | 953 | CGCUACCUCAGCCUCAGGA | 1138 |
| AD-73907 | A-147959 | UCAGGAACAACUCACUGCGdTdT | 769 | A-147960 | UGCAGUGAGUUGUUCCUGAdTdT | 954 | UCAGGAACAACUCACUGCG | 1139 |
| AD-73908 | A-147961 | CUCACUGCGGACCUUCACAdTdT | 770 | A-147962 | UGUGAAGGUCCGCAGUGAGdTdT | 955 | CUCACUGCGGACCUUCACG | 1140 |
| AD-73909 | A-147963 | ACCUUCACGCCGCAGCCCAdTdT | 771 | A-147964 | UGGGCUGCGGCGUGAAGGUdTdT | 956 | ACCUUCACGCCGCAGCCCC | 1141 |
| AD-73910 | A-147965 | CAGCCCCGGGCCUGGAGAdTdT | 772 | A-147966 | UCUCCAGGCCCGGGGGCUGdTdT | 957 | CAGCCCCGGGCCUGGAGC | 1142 |
| AD-73911 | A-147967 | GCCUGGAGCGCCUGGUGGCUdTdT | 773 | A-147968 | AGCCACAGGCGCUCCAGGCdTdT | 958 | GCCUGGAGCGCCUGGUGGCU | 1143 |
| AD-73912 | A-147969 | CUGUGGCUGAGGGUAACCdTdT | 774 | A-147970 | UGUUACCCUCCAGCCACAGdTdT | 959 | CUGUGGCUGAGGGUAACC | 1144 |
| AD-73913 | A-147971 | GGUAACCCUGGAGACGUAdTdT | 775 | A-147972 | UACAGUCCCAGGGGUUACCdTdT | 960 | GGUAACCCUGGAGACGUG | 1145 |
| AD-73914 | A-147973 | GGGACUGUGGCUGCCCUCUdTdT | 776 | A-147974 | AGAGGGCAGCCACAGUCCCdTdT | 961 | GGGACUGUGGCUGCCCUCU | 1146 |
| AD-73915 | A-147975 | UGCCCUCUCAAGGCGCUGAdTdT | 777 | A-147976 | UCAGCGCCUUGAGAGGGCAdTdT | 962 | UGCCCUCUCAAGGCGCUGC | 1147 |
| AD-73916 | A-147977 | CGCUGCGGGACUUCGCCCUdTdT | 778 | A-147978 | AGGGCGAAGUCCCGCAGCGdTdT | 963 | CGCUGCGGGACUUCGCCCU | 1148 |
| AD-73917 | A-147979 | UUCGCCCUGCAGAACCCCAdTdT | 779 | A-147980 | UGGGGUUCUGCAGGGCGAAdTdT | 964 | UUCGCCCUGCAGAACCCCA | 1149 |
| AD-73918 | A-147981 | CAGAACCCCAGUGCUGUGAdTdT | 780 | A-147982 | UCACAGCACUGGGGUUCUGdTdT | 965 | CAGAACCCCAGUGCUGUGC | 1150 |
| AD-73919 | A-147983 | UGCUGUGCCCCGCCUUCGUdTdT | 781 | A-147984 | UACGAAGCGGGGCACAGCAdTdT | 966 | UGCUGUGCCCCGCCUUCGUC | 1151 |
| AD-73920 | A-147985 | CUUCGUCCAGCCAUCUGUdTdT | 782 | A-147986 | ACAGAUGGCUGGACGAAGdTdT | 967 | CUUCGUCCAGCCAUCUGU | 1152 |
| AD-73921 | A-147987 | CAUCUGUGAGGGGACCAUdTdT | 783 | A-147988 | AUCGUCCCCUCACAGAUGGdTdT | 968 | CAUCUGUGAGGGGACGAU | 1153 |
| AD-73922 | A-147989 | GGGGACGAUUGCCAGCCGCdTdT | 784 | A-147990 | UCGGCUGGCAAUCGUCCCCdTdT | 969 | GGGGACGAUUGCCAGCCGC | 1154 |
| AD-73923 | A-147991 | CAGCCGCCCGCUACACCUdTdT | 785 | A-147992 | AGGUGUACGCGGGCGGCUGdTdT | 970 | CAGCCGCCCGCUACACCU | 1155 |
| AD-73924 | A-147993 | CGUACACCUACAACAACAUdTdT | 786 | A-147994 | AUGUUGUUGUAGGUGUACGdTdT | 971 | CGUACACCUACAACAACAU | 1156 |
| AD-73925 | A-147995 | AACAACAUCACACCUGCCAdTdT | 787 | A-147996 | UGGCAGGUGAUGUUGUUdTdT | 972 | AACAACAUCACACCUGCCA | 1157 |
| AD-73926 | A-147997 | UGUGCCAGCCCGCCCGAGAdTdT | 788 | A-147998 | UCUCGGGCGGGCUGGCACAdTdT | 973 | UGUGCCAGCCCGCCCGAGG | 1158 |
| AD-73927 | A-147999 | CGCCCGAGGUCGUGGGGCUdTdT | 789 | A-148000 | AGCCCCACGACCUCGGGCGdTdT | 974 | CGCCCGAGGUCGUGGGGCU | 1159 |

TABLE 8-continued

Modified Sense and Antisense Strand Sequences of IGFALS dsRNAs

| Duplex Name | Sense Oligo Name | Sense Oligo Sequence | SEQ ID | Antisense Oligo Name | Antisense Oligo Seq | SEQ ID | mRNA target sequence | SEQ ID |
|---|---|---|---|---|---|---|---|---|
| AD-73928 | A-148001 | CGUGGGCUCGACCUGCGAdTdT | 790 | A-148002 | UCGCAGGUCGAGCCCCACGdTdT | 975 | CGUGGGCUCGACCUGCGG | 1160 |
| AD-73929 | A-148003 | ACCUGCGGGACCUCAGCGAdTdT | 791 | A-148004 | UCGCUGAGGUCCCGCAGGUdTdT | 976 | ACCUGCGGGACCUCAGCGA | 1161 |
| AD-73930 | A-148005 | UCAGCGAGGCCCACUUUGCdTdT | 792 | A-148006 | UCAAAGUGGGCCUCGCUGAdTdT | 977 | UCAGCGAGGCCCACUUUGC | 1162 |
| AD-73931 | A-148007 | ACUUUGCUCCCUGCUGACAdTdT | 793 | A-148008 | UGUCAGCAGGGAGCAAAGUdTdT | 978 | ACUUUGCUCCCUGCUGACC | 1163 |
| AD-73932 | A-148009 | CCUGCUGACCAGGUCCCCAdTdT | 794 | A-148010 | UGGGGACCUGGUCAGCAGGdTdT | 979 | CCUGCUGACCAGGUCCCCG | 1164 |
| AD-73933 | A-148011 | UCCCCGACUCAAGCCCCAdTdT | 795 | A-148012 | UGGGGCUUGAGUCCGGGGAdTdT | 980 | UCCCCGACUCAAGCCCCG | 1165 |
| AD-73934 | A-148013 | CAAGCCCCGGACUCAGCCdTdT | 796 | A-148014 | UGCCUGAGUCCGGGGCUUGdTdT | 981 | CAAGCCCCGGACUCAGCC | 1166 |
| AD-73935 | A-148015 | UCAGGCCCCCACCUGCUAdTdT | 797 | A-148016 | UAGCCAGGUGGGGGCCUGAdTdT | 982 | UCAGGCCCCCACCUGCUC | 1167 |
| AD-73936 | A-148017 | ACCUGGCUCACCUUGUCUdTdT | 798 | A-148018 | AGCACAAGGUGAGCCAGGUdTdT | 983 | ACCUGGCUCACCUUGUGCU | 1168 |
| AD-73937 | A-148019 | UUGUGCUGGGGACAGUCAdTdT | 799 | A-148020 | UGACUGUCCCCAGCACAAdTdT | 984 | UUGUGCUGGGGACAGUCC | 1169 |
| AD-73938 | A-148021 | GACAGGUCCUCAGUGUCCUdTdT | 800 | A-148022 | AGGACACUGAGGACCUGUCdTdT | 985 | GACAGGUCCUCAGUGUCCU | 1170 |
| AD-73939 | A-148023 | CAGUGUCCUCAGGGGCCUAdTdT | 801 | A-148024 | UAGGCCCCUGAGGACACUGdTdT | 986 | CAGUGUCCUCAGGGGCCUG | 1171 |
| AD-73940 | A-148025 | GGGCCUGCCCAGUGCACUUdTdT | 802 | A-148026 | AAGUGCACUGGGCAGGGCCdTdT | 987 | GGGCCUGCCCAGUGCACUU | 1172 |
| AD-73941 | A-148027 | UGCACUUGCUGGAAGACGAdTdT | 803 | A-148028 | UCGUCUUCCAGCAAGUGCAdTdT | 988 | UGCACUUGCUGGAAGACGC | 1173 |
| AD-73942 | A-148029 | UGGAAGACGCAAGGGCCUAdTdT | 804 | A-148030 | UAGGCCCUUGCGUCUUCCAdTdT | 989 | UGGAAGACGCAAGGGCCUG | 1174 |
| AD-73943 | A-148031 | AGGGCCUGAUGGGGUGAAdTdT | 805 | A-148032 | UUCCACCCAUCAGGCCCUdTdT | 990 | AGGGCCUGAUGGGGUGGAA | 1175 |
| AD-73944 | A-148033 | GGGUGGAAGGCAUGGCGGAdTdT | 806 | A-148034 | UCCGCCAUGCCUUCCACCCdTdT | 991 | GGGUGGAAGGCAUGGCGGC | 1176 |
| AD-73945 | A-148035 | UGGCCGGCCCCCCAGCUGUdTdT | 807 | A-148036 | ACAGCUGGGGGGCCGCCAdTdT | 992 | UGGCCGGCCCCCCAGCUGU | 1177 |
| AD-73946 | A-148037 | CAGCUGUCAUCAAUUAAAGdTdT | 808 | A-148038 | CUUUAAUUGAUGACAGCUGdTdT | 993 | CAGCUGUCAUCAAUUAAAG | 1178 |
| AD-73947 | A-148039 | AAUUAAAGGCAAAGGCAAUdTdT | 809 | A-148040 | AUUGCCUUUGCCUUUAAUUdTdT | 994 | AAUUAAAGGCAAAGGCAAU | 1179 |
| AD-73948 | A-148041 | AAGGCAAUCGAAUCUAAAAdTdT | 810 | A-148042 | UUUUAGAUUCGAUUGCCUUdTdT | 995 | AAGGCAAUCGAAUCUAAAA | 1180 |

Example 5-In Vitro Screening

Cell Culture and Plasmids/Transfections for Dual-Glo® Assay:

HeLa cells (ATCC) were transfected by adding 4.9 µl of Opti-MEM plus 0.1 µl of Lipofectamine RNAiMax per well (Invitrogen, Carlsbad Calif. cat #13778-150) to 5 µl of siRNA duplexes per well into a 384-well plate and incubated at room temperature for 15 minutes. Forty µl of Dulbecco's Modified Eagle Medium (Life Tech) containing ~5×10$^3$ cells were then added to the siRNA mixture. Cells were incubated for 24 hours prior to RNA purification. Single dose experiments were performed at 10 nM and 0.1 nM.

Total RNA Isolation Using DYNABEADS mRNA Isolation Kit

RNA was isolated using an automated protocol on a BioTek-EL406 platform using DYNABEADs (Invitrogen, cat #61012). Briefly, 50 µl of Lysis/Binding Buffer and 25 µl of lysis buffer containing 3 µl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 µl Wash Buffer A and once with Wash Buffer B. Beads were then washed with 150 µl Elution Buffer, re-captured and supernatant removed.

cDNA Synthesis Using ABI High Capacity cDNA Reverse Transcription Kit (Applied Biosystems, Foster City, Calif., Cat #4368813)

Ten µl of a master mix containing 1 µl 10× Buffer, 0.4 µl 25× dNTPs, 1 µl 10× Random primers, 0.5 µl Reverse Transcriptase, 0.5 µl RNase inhibitor and 6.6 µl of H$_2$O per reaction was added to RNA isolated above. Plates were sealed, mixed, and incubated on an electromagnetic shaker for 10 minutes at room temperature, followed by 2 hours at 37° C.

Real Time PCR

Two µl of cDNA were added to a master mix containing 0.5 µl of Human GAPDH TaqMan Probe (4326317E), 0.5 µl IGF-1 human probe (Hs01547656_m1) and 5 µl Lightcycler 480 probe master mix (Roche Cat #04887301001) per well in a 384 well plates (Roche cat #04887301001). Real time PCR was done in a LightCycler480 Real Time PCR system (Roche). Each duplex was tested in duplicate and data were normalized to cells transfected with a non-targeting control siRNA.

To calculate relative fold change, real time data were analyzed using the ΔΔCt method and normalized to assays performed with cells transfected with a non-targeting control siRNA.

TABLE 9

Unmodified Sense and Antisense Strand Sequences of IGF-1 dsRNAs

| Duplex Name | Sense Oligo Name | Sense sequence | Range in SEQ ID No.: 11 | SEQ ID NO | Antisense Oligo Name | Antisense equence | Range in SEQ ID No.: 11 | SEQ ID NO |
|---|---|---|---|---|---|---|---|---|
| AD-66716 | A-133440 | GCUGCUUCCGAGCUGUGAUA | 548-568 | 1181 | A-133441 | UAUCACAGCUCCGAAGCAGCAC | 546-568 | 1247 |
| AD-66717 | A-133442 | UCUGCGGGGCUGAGCUGGUGA | 422-442 | 1182 | A-133443 | UCACCAGCUCAGCCCCGCAGAGC | 420-442 | 1248 |
| AD-66718 | A-133444 | CCUGCUCACCUUCACCAGCUA | 378-398 | 1183 | A-133445 | UAGCUGGUGAAGGUGAGCAGCA | 376-398 | 1249 |
| AD-66719 | A-133446 | GUGGAGACAGGGGCUUUUAUU | 461-481 | 1184 | A-133447 | AAUAAAAGCCCCUGUCUCCACAC | 459-481 | 1250 |
| AD-66720 | A-133448 | UGGAGACAGGGGCUUUUAUUU | 462-482 | 1185 | A-133449 | AAAUAAAAGCCCCUGUCUCCACA | 460-482 | 1251 |
| AD-66721 | A-133450 | GAGACAGGGGCUUUUAUUUCA | 464-484 | 1186 | A-133451 | UGAAAUAAAAGCCCCUGUCUCCA | 462-484 | 1252 |
| AD-66722 | A-133452 | CAUGUCCUCCUCGCAUCUCUU | 342-362 | 1187 | A-133453 | AAGAGAUGCGAGGAGGACAUGGU | 340-362 | 1253 |
| AD-66723 | A-133454 | UUUUAUUUCAACAGCCCCACA | 475-495 | 1188 | A-133455 | UGUGGGGCUGUUGAAAUAAAAGC | 473-495 | 1254 |
| AD-66724 | A-133456 | UGUGGAGACAGGGGCUUUUAU | 460-480 | 1189 | A-133457 | AUAAAAGCCCCUGUCUCCACACA | 458-480 | 1255 |
| AD-66725 | A-133458 | UGGAGAUGAGUGCUGUUCCGA | 539-559 | 1190 | A-133459 | UCCGGAAGCAGCACUCAUCCACG | 537-559 | 1256 |
| AD-66726 | A-133460 | UCGUGUGUGGAGACAGGGGCU | 455-475 | 1191 | A-133461 | AGCCCCUGUCUCCACACACGAAC | 453-475 | 1257 |
| AD-66727 | A-133462 | GAUGUAUUGCGCACCCCUCAA | 582-602 | 1192 | A-133463 | UUGAGGGGUGCGCAAUACAUCUC | 580-602 | 1258 |
| AD-66728 | A-133464 | UUCAGUUCGUGUGUGGAGACA | 449-469 | 1193 | A-133465 | UGUCUCCACACACGAACUGAAGA | 447-469 | 1259 |
| AD-66729 | A-133466 | CUCCCUCGCAUCUCUCUACCU | 348-368 | 1194 | A-133467 | AGGUAGAGAGAUGCGAGGAGGA | 346-368 | 1260 |
| AD-66730 | A-133468 | AGAUGUAUUGCGCACCCCUCA | 581-601 | 1195 | A-133469 | UGAGGGGUGCGCAAUACAUCUCC | 579-601 | 1261 |
| AD-66731 | A-133470 | GCCACACCGACAUGCCCAAGA | 638-658 | 1196 | A-133471 | UCUUGGGCAUGUCGGUGUGGCGC | 636-658 | 1262 |
| AD-66732 | A-133472 | GGAGAUGUAUUGCGCACCCCU | 579-599 | 1197 | A-133473 | AGGGGUGCGCAAUACACUCCAG | 577-599 | 1263 |
| AD-66733 | A-133474 | UUCAACAAGCCCAAGGGUAU | 481-501 | 1198 | A-133475 | AUACCCUUGGGCUUGUUGAAAU | 479-501 | 1264 |
| AD-66734 | A-133476 | UGCCCAGCGCCACACCGACAU | 630-650 | 1199 | A-133478 | AUGUCGGUGUGGGCGCUGGGCACG | 628-650 | 1265 |
| AD-66735 | A-133480 | GCAUCGUGGAUGAGUGCUGCU | 533-553 | 1200 | A-133482 | AGCAGCACUCAUCCACGAUGCCU | 531-553 | 1266 |
| AD-66736 | A-133484 | GGAGACAGGGGCUUUUAUUUA | 463-483 | 1201 | A-133486 | UAAAUAAAAGCCCCUGUCUCCAC | 461-483 | 1267 |
| AD-66737 | A-133488 | GGGCUUUAUUUCAACAAGCA | 471-491 | 1202 | A-133490 | UGCUUGUUGAAAUAAAAGCCCCU | 469-491 | 1268 |
| AD-66738 | A-133492 | UCGUGGAUGAGUGCUGCUUCA | 536-556 | 1203 | A-133494 | UGAAGCAGCACUCAUCCACGAUG | 534-556 | 1269 |

TABLE 9-continued

Unmodified Sense and Antisense Strand Sequences of IGF-1 dsRNAs

| | | | | | | | |
|---|---|---|---|---|---|---|---|
| AD-66739 | A-133496 | UCCUCGCAUCUCUUCUACCUA | 349-369 | 1204 | A-133498 | UAGGUAGAAGAUGCGAGGAGG | 347-369 | 1270 |
| AD-66740 | A-133500 | GGGGCUUUUAUUUCAACAAGA | 470-490 | 1205 | A-133502 | UCUUGUUGAAAUAAAGCCCUG | 468-490 | 1271 |
| AD-66741 | A-133504 | UUUAUUUCAACAAGCCCACAA | 476-496 | 1206 | A-133506 | UUGUGGGCUUGUUGAAAUAAAG | 474-496 | 1272 |
| AD-66742 | A-133508 | GCUGGAGAUGUAUUGCGCACA | 576-596 | 1207 | A-133510 | UGUGCGCAAUACAUCUCCAGCU | 574-596 | 1273 |
| AD-66743 | A-133512 | GGGUAUGGCUCCAGCAGUCGA | 496-516 | 1208 | A-133513 | UCGACUGCUGGAGCCAUACCCUG | 494-516 | 1274 |
| AD-66744 | A-133514 | CUGGAGAUGUAUUGCGCACCA | 577-597 | 1209 | A-133515 | UGGUGCGCAAUACAUCUCCAGCC | 575-597 | 1275 |
| AD-66745 | A-133516 | GAAGAUGCACACCAUGUCCUA | 330-350 | 1210 | A-133517 | UAGGACAUGGUGUGCAUCUCAC | 328-350 | 1276 |
| AD-66746 | A-133477 | GAUGCUCUUCAGUUCGUGUGU | 442-462 | 1211 | A-133479 | ACACACGAACUGAAGAGCAUCCA | 440-462 | 1277 |
| AD-66747 | A-133481 | UGGAUGCUCUUCAGUUCGUGU | 440-460 | 1212 | A-133483 | ACACGAACUGAAGAGCAUCCACC | 438-460 | 1278 |
| AD-66748 | A-133485 | GGUGGAUGCUCUUCAGUUCGU | 438-458 | 1213 | A-133487 | ACGAACUGAAGAGCAUCCACCAG | 436-458 | 1279 |
| AD-66749 | A-133489 | UGAGCUGGUGGAUGCUCUUCA | 432-452 | 1214 | A-133491 | UGAAGAGCAUCCACCAGCUCAGC | 430-452 | 1280 |
| AD-66750 | A-133493 | GCUGGUGGAUGCUCUUUCAGUU | 435-455 | 1215 | A-133495 | AACUGAAGAGCAUCCACCAGCUC | 433-455 | 1281 |
| AD-66751 | A-133497 | GGAUGCUCUUCAGUUCGUGUA | 441-461 | 1216 | A-133499 | UACACGAACUGAAGAGCAUCCAC | 439-461 | 1282 |
| AD-66752 | A-133501 | CUGGUGGAUGCUCUUCAGUUA | 436-456 | 1217 | A-133503 | UAACUGAAGAGCAUCCACCAGCU | 434-456 | 1283 |
| AD-66753 | A-133505 | GGCUGAGCUGGUGGAUGCUCU | 429-449 | 1218 | A-133507 | AGAGCAUCCACCAGCUCAGCCCC | 427-449 | 1284 |
| AD-66754 | A-133509 | CUGAGCUGGUGGAUGCUCUUA | 431-451 | 1219 | A-133511 | UAAGAGCAUCCACCAGCUCAGCC | 429-451 | 1285 |
| AD-66755 | A-133518 | CAUUGGAUGAGAGUUUGCUU | 534-554 | 1220 | A-133519 | AAGCAACAUCUCAUCCACAAUGCC | 532-554 | 1286 |
| AD-66756 | A-133520 | AGAUACACAUCAUGUCGUCUU | * | 1221 | A-133521 | AAGACGACAUGAUGUGUAUCUUU | * | 1287 |
| AD-66757 | A-133522 | UGGAUGAGUUGUUCUUCCGGA | 539-559 | 1222 | A-133523 | UCCGGAAGCAACACUCAUCCACA | 537-559 | 1288 |
| AD-66758 | A-133524 | UGUUGCUUCCGGAGCUGUGAU | 547-567 | 1223 | A-133525 | AUCACAGCUCCGGAAGCAACAU | 545-567 | 1289 |
| AD-66759 | A-133526 | GCUUUUACUUCAACAAGCCCA | 473-493 | 1224 | A-133527 | UGGGCUUGUUGAAGUAAAAGCCC | 471-493 | 1290 |
| AD-66760 | A-133528 | AUGAGUUGUUCUUCCGGAGCU | 542-562 | 1225 | A-133529 | AGCUCCGGAAGCAACACUCAUCC | 540-562 | 1291 |
| AD-66761 | A-133530 | CACACUGACAUGCCCAAGACU | 640-660 | 1226 | A-133531 | AGUCUUGGGCAUGUCAGUGUGGC | 638-660 | 1292 |
| AD-66762 | A-133532 | GCUAUGGCUCCCAGACAUUCGA | 497-517 | 1227 | A-133533 | UCCGAAUGCUGGAGCCAUAGCCU | 495-517 | 1293 |
| AD-66763 | A-133534 | AAGUACACACAUGUCGUCU | * | 1228 | A-133535 | AGAUACGACAUGUGUAUCUUUA | * | 1294 |

TABLE 9-continued

Unmodified Sense and Antisense Strand Sequences of IGF-1 dsRNAs

| Duplex Name | Sense Oligo Name | Sense sequence | Range in SEQ ID No.: 17 | SEQ ID NO | Antisense Oligo Name | Antisense equence | Range in SEQ ID No.: 17 | SEQ ID NO |
|---|---|---|---|---|---|---|---|---|
| AD-66764 | A-133536 | UUGCUUCCGAGCUGUGAUCU | 549-569 | 1229 | A-133537 | AGAUCACAGCUCCGAAGCAACA | 547-569 | 1295 |
| AD-66765 | A-133538 | UCCGGAGCUGUGAUCUGAGGA | 554-574 | 1230 | A-133539 | UCCUCAGAUCACAGCUCCGAAG | 552-574 | 1296 |
| AD-66766 | A-133540 | GUGGAUGAGUGUUGCUUCCGA | 538-558 | 1231 | A-133541 | UCGGAAGCAACACUCAUCCACAA | 536-558 | 1297 |
| AD-66767 | A-133542 | UACACAUCAUGUCGUCUUCAA | * | 1232 | A-133543 | UUGAAGACGACAUGAUGUGUAUC | * | 1298 |
| AD-66768 | A-133544 | AAAGAUACACAUCAUGUCGUA | * | 1233 | A-133545 | UACGACAUGAUGUGUAUCUUUAU | * | 1299 |
| AD-66769 | A-133546 | GGCUAUGGCUCCAGCAUUCGA | 496-516 | 1234 | A-133547 | UCGAAUGCUGGAGCCAUAGCCUG | 494-516 | 1300 |
| AD-66770 | A-133548 | ACACUGACAUGCCCAAGACUA | 641-661 | 1235 | A-133549 | UAGUCUUGGGCAUGUCAGUGUGG | 639-661 | 1301 |
| AD-66771 | A-133550 | AGUGUUGCUUCCGAGCUGUGA | 545-565 | 1236 | A-133551 | UACAGCUCCGAAGCAACACUCA | 543-565 | 1302 |
| AD-66772 | A-133552 | GAGACCCUUUGCGGGGCUGAA | * | 1237 | A-133553 | UUCAGCCCCGCAAAGGGUCUCUG | * | 1303 |
| AD-66773 | A-133554 | ACUGACAUGCCCAAGACUCAA | 643-663 | 1238 | A-133555 | UUGAGUCUUGGGCAUGUCAGUGU | 641-663 | 1304 |
| AD-66774 | A-133556 | GAUACACAUCAUGUCGUCUUA | * | 1239 | A-133557 | UAAGACGACAUGAUGUGUAUCUU | * | 1305 |
| AD-66775 | A-133558 | AAGCCCACAGGCUAUGGCUCA | 487-507 | 1240 | A-133559 | UGAGCCAUAGCCUGUGGGCUGU | 485-507 | 1306 |

| Duplex Name | Sense Oligo Name | Sense sequence | Range in SEQ ID No.: 17 | SEQ ID NO | Antisense Oligo Name | Antisense equence | Range in SEQ ID No.: 17 | SEQ ID NO |
|---|---|---|---|---|---|---|---|---|
| AD-66756 | A-133520 | AGAUACACAUCAUGUCGUCUU | 366-368 | 1241 | A-133521 | AAGACGACAUGAUGUGUAUCUUU | 364-368 | 1307 |
| AD-66763 | A-133534 | AAGAUACACAUCAUGUCGUCU | 365-385 | 1242 | A-133535 | AGACGACAUGAUGUGUAUCUUUA | 363-385 | 1308 |
| AD-66767 | A-133542 | UACACAUCAUGUCGUCUUCAA | 369-389 | 1243 | A-133543 | UUGAAGACGACAUGAUGUGUAUC | 367-389 | 1309 |
| AD-66768 | A-133544 | AAAGAUACACAUCAUGUCGUA | 364-384 | 1244 | A-133545 | UACGACAUGAUGUGUAUCUUUAU | 362-384 | 1310 |
| AD-66772 | A-133552 | GAGACCCUUUGCGGGGCUGAA | 449-469 | 1245 | A-133553 | UUCAGCCCCGCAAAGGGUCUCUG | 447-469 | 1311 |
| AD-66774 | A-133556 | GAUACACAUCAUGUCGUCUUA | 367-387 | 1246 | A-133557 | UAAGACGACAUGAUGUGUAUCUU | 365-387 | 1312 |

*Targeting sequence in NM_010512 (SEQ ID NO: 7).

TABLE 10

IGF-1 Screen in HeLa cells
Each duplex was tested in duplicate and data were normalized to
cells transfected with a non-targeting control siRNA AD-1955.

| Duplex ID | 10 nM Avg | STDEV | 0.1 nM Avg | STDEV |
|---|---|---|---|---|
| AD-66716 | 58.4 | 3.1 | 90.3 | 24.0 |
| AD-66717 | 82.2 | 1.6 | 81.1 | 10.3 |
| AD-66718 | 62.7 | 7.0 | 76.4 | 10.1 |
| AD-66719 | 51.0 | 6.7 | 83.2 | 8.1 |
| AD-66720 | 30.3 | 0.9 | 74.9 | 15.7 |
| AD-66721 | 58.0 | 8.5 | 82.5 | 23.9 |
| AD-66722 | 4.7 | 1.0 | 29.2 | 9.0 |
| AD-66723 | 70.5 | 7.3 | 85.4 | 11.3 |
| AD-66724 | 32.4 | 8.0 | 82.7 | 9.7 |
| AD-66725 | 22.6 | 6.4 | 72.8 | 12.1 |
| AD-66726 | 32.8 | 2.1 | 76.4 | 25.0 |
| AD-66727 | 53.5 | 1.1 | 83.1 | 6.5 |
| AD-66728 | 59.1 | 11.5 | 91.5 | 15.2 |
| AD-66729 | 27.9 | 4.2 | 75.3 | 27.4 |
| AD-66730 | 79.1 | 12.7 | 87.8 | 18.4 |
| AD-66731 | 86.4 | 15.9 | 97.0 | 25.4 |
| AD-66732 | 81.0 | 8.3 | 80.9 | 15.0 |
| AD-66733 | 8.7 | 3.7 | 43.7 | 1.9 |
| AD-66734 | 65.4 | 3.2 | 83.7 | 15.5 |
| AD-66735 | 62.0 | 6.7 | 82.6 | 8.1 |
| AD-66736 | 71.9 | 4.5 | 83.5 | 23.4 |
| AD-66737 | 68.7 | 4.0 | 92.0 | 14.4 |
| AD-66738 | 19.2 | 3.3 | 79.4 | 14.3 |
| AD-66739 | 10.6 | 2.7 | 61.8 | 23.6 |
| AD-66740 | 23.2 | 4.4 | 68.2 | 14.6 |
| AD-66741 | 83.6 | 0.5 | 76.5 | 14.2 |
| AD-66742 | 73.1 | 2.2 | 86.2 | 10.1 |
| AD-66743 | 58.9 | 1.8 | 88.1 | 11.2 |
| AD-66744 | 53.9 | 2.1 | 96.8 | 7.6 |
| AD-66745 | 28.3 | 5.5 | 76.8 | 7.9 |
| AD-66746 | 6.3 | 0.7 | 50.1 | 3.9 |
| AD-66747 | 8.5 | 2.8 | 50.0 | 0.0 |
| AD-66748 | 6.2 | 1.3 | 34.8 | 4.1 |
| AD-66749 | 30.0 | 0.5 | 92.4 | 3.2 |
| AD-66750 | 27.6 | 0.7 | 74.8 | 1.5 |
| AD-66751 | 50.1 | 0.3 | 89.3 | 15.2 |
| AD-66752 | 9.6 | 1.3 | 55.5 | 12.4 |
| AD-66753 | 54.6 | 2.1 | 89.0 | 0.9 |
| AD-66754 | 78.6 | 16.8 | 104.3 | 2.0 |
| AD-66755 | 46.8 | 4.8 | 103.4 | 18.6 |
| AD-66756 | 86.3 | 2.5 | 95.9 | 18.2 |
| AD-66757 | 69.1 | 0.7 | 103.0 | 5.0 |
| AD-66758 | 67.5 | 3.6 | 86.5 | 2.5 |
| AD-66759 | 106.5 | 16.2 | 91.4 | 20.4 |
| AD-66760 | 54.2 | 1.6 | 86.8 | 0.4 |
| AD-66761 | 40.8 | 3.8 | 92.2 | 7.2 |
| AD-66762 | 96.8 | 7.1 | 100.6 | 8.4 |
| AD-66763 | 81.2 | 11.4 | 92.1 | 0.0 |
| AD-66764 | 86.0 | 2.2 | 101.2 | 12.9 |
| AD-66765 | 100.9 | 13.7 | 93.2 | 25.3 |
| AD-66766 | 36.6 | 3.9 | 78.5 | 15.7 |
| AD-66767 | 124.0 | 12.2 | 89.9 | 1.3 |
| AD-66768 | 113.9 | 15.1 | 92.7 | 15.4 |
| AD-66769 | 92.0 | 7.1 | 93.6 | 8.2 |
| AD-66770 | 79.7 | 3.6 | 98.7 | 1.9 |
| AD-66771 | 60.6 | 12.1 | 97.6 | 10.5 |
| AD-66772 | 95.5 | 7.0 | 95.9 | 9.9 |
| AD-66773 | 61.3 | 3.9 | 90.7 | 7.5 |
| AD-66774 | 95.6 | 8.9 | 81.9 | 21.8 |
| AD-66775 | 113.1 | 13.9 | 99.5 | 6.8 |
| AD-1955 | 100.0 | 8.0 | | |

TABLE 11

Modified Sense and Antisense Sequences of IGF-1

| Duplex Name | Sense Oligo Name | Modified Sense Sequence | SEQ ID NO | Antisense Oligo Name | Modified Antisense Sequence | SEQ ID NO: |
|---|---|---|---|---|---|---|
| AD-66716 | A-133440 | GfscsUfgCfuUfccCfgGfGfaGfcUfgUfgAfuAfL96 | 1313 | A-133441 | usAfsuCfaCfaGfcUfccgGfaAfgCfaGfcsasc | 1373 |
| AD-66717 | A-133442 | UfscsUfgCfgGfgCfCfUfgAfgCfuGfugGfuGfAfL96 | 1314 | A-133443 | usCfsaCfcAfgCfuCfagcCfcCfgCfaGfasgsc | 1374 |
| AD-66718 | A-133444 | CfscsUfgCfuCfaCfCfUfuCfaCfcAfgCfuAfL96 | 1315 | A-133445 | usAfsgCfuGfgUfgAfaggUfgAfgCfaGfgscsa | 1375 |
| AD-66719 | A-133446 | GfsasGfgAfgAfcAfgGfGfgGfcUfuUfaAfuUfL96 | 1316 | A-133447 | asAfsuAfaAfaGfcCfccuGfucfucCfAfcsasc | 1376 |
| AD-66720 | A-133448 | UfsgsGfaGfaCfaGfgGfgCfuUfuAfuUfuUfL96 | 1317 | A-133449 | asAfsaUfaAfaAfgCfcccUfgUfcUfcfascsa | 1377 |
| AD-66721 | A-133450 | GfsasGfaCfaGfgGfgCfuUfuAfuUfuUfcAfL96 | 1318 | A-133451 | usGfsaAfaUfaAfaAfgccCfcuGfuCfUfcscsa | 1378 |
| AD-66722 | A-133452 | CfsasUfgUfcCfuCfuGfcAfuCfuCfuUfL96 | 1319 | A-133453 | asAfsgAfgAfuGfcGfaggAfgAfcCfaUfgsgsu | 1379 |
| AD-66723 | A-133454 | UfsusUfuAfuUfuCfAfAfcAfaGfcCfcAfcAfL96 | 1320 | A-133455 | usGfsuGfgGfcUfuGfuugAfaAfuAfaAfasgsc | 1380 |
| AD-66724 | A-133456 | UfsusUfgGfaGfaCfAfGfGfgCfgGfcUfuUfaUfL96 | 1321 | A-133457 | asUfsaAfaAfgCfcCfcuGfuCfucCfacCfascsa | 1381 |
| AD-66725 | A-133458 | UfsgsGfaUfgAfgUfGfCfuGfuCfuUfCfcGfgAfL96 | 1322 | A-133459 | usCfscGfaAfgAfcCfuGfcaCfucAfucCfascsg | 1382 |
| AD-66726 | A-133460 | UfscsGfuGfuGfuUfgCfGfcAfcAfgGfgGfcUfL96 | 1323 | A-133461 | asGfscCfcCfuGfuCfuccAfcAfcAfcGfasasc | 1383 |
| AD-66727 | A-133462 | GfsasUfgUfaUfUfgCfCfgCfaUfcCfuCfaAfL96 | 1324 | A-133463 | usUfsgAfgGfgAfuGfcAfaUfaCfaUfcsusc | 1384 |
| AD-66728 | A-133464 | UfsusCfaGfuUfcGfUfGfuGfcGfaGfaCfaCfL96 | 1325 | A-133465 | UfsuUfgCfcAfcAfcGfaAfcUfgAfasgsa | 1385 |
| AD-66729 | A-133466 | CfsusCfcUfcGfcAfUfUfCfcUfuCfuAfcCfL96 | 1326 | A-133467 | asGfsgUfaGfaAfgAfauGfcGfaGfAfgsgsa | 1386 |
| AD-66730 | A-133468 | AfsgsAfuGfaUfuGfCfCfgCfaCfcCfuUfcUfL96 | 1327 | A-133469 | usGfsaAfgGfgUfgCfgcAfaAfuCfAfuCfuscsc | 1387 |
| AD-66731 | A-133470 | GfscsCfaCfcCfuGfAfCffaUfgCfcCfaAfgAfL96 | 1328 | A-133471 | usCfsuUfgGfgCfaUfguCfgUfgUfgGfcsgsc | 1388 |
| AD-66732 | A-133472 | GfsgsAfgAfuUfgGfCfCfaCffaCfAfuCfUfL96 | 1329 | A-133473 | asGfsgGfgUfgCfgCfaauAfcAfuCfuCfcsasg | 1389 |
| AD-66733 | A-133474 | UfsusCfaAfcAfaGfcCfcAfcAfgGfgUfaUfL96 | 1330 | A-133475 | asUfsaCfcCfuGfuGfggcUfuGfuUfgAfasasu | 1390 |
| AD-66734 | A-133476 | UfsgsCfcCfaGfcGfcCfcAfcAfcCfcGfaCfaUfL96 | 1331 | A-133478 | asUfsgUfcGfgUfgUfggeGfcUfgGfgCfascsg | 1391 |
| AD-66735 | A-133480 | GfscsAfuCfgUfgGfGfAfGfcAfcCfaCfgAfuGfL96 | 1332 | A-133482 | asGfscAfgCfaCfuCfauCfCfaGfcAfuGfcsssc | 1392 |
| AD-66736 | A-133484 | GfsgsAfgAfcAfgGfGfgGfcUfUfUfaAfcAfL96 | 1333 | A-133486 | usAfsaAfuAfaAfuAfaGfcccCfuGfuCfscsasc | 1393 |
| AD-66737 | A-133488 | GfsgsGfcUfuUfaUfUfUfuCfaAfcAfaGfcAfL96 | 1334 | A-133490 | usCfsUfuGfuUfgAfaauAfaAfaGfcCfcscsu | 1394 |
| AD-66738 | A-133492 | UfscsGfiuGfAfuGfAfGfuGfcUfgUfcAfL96 | 1335 | A-133494 | usGfsaAfgCfaGfcAfcucAfucCfAfcGfasusg | 1395 |

TABLE 11-continued

Modified Sense and Antisense Sequences of IGF-1

| Duplex Name | Sense Oligo Name | Modified Sense Sequence | SEQ ID NO | Antisense Oligo Name | Modified Antisense Sequence | SEQ ID NO: |
|---|---|---|---|---|---|---|
| AD-66739 | A-133496 | UfscsCfucCfgCfaUfCfUfcUfucUfuAfcCfuAfL96 | 1336 | A-133498 | usAfsgGfuAfgAfaGfagaUfgCfgAfgGfasgsg | 1396 |
| AD-66740 | A-133500 | GfsgsGfgCfuUfuUfAfUfuUfcAfaCfaAfgAfL96 | 1337 | A-133502 | usCfsuUfgUfuGfaAfauaAfaAfgCfcCfcsusg | 1397 |
| AD-66741 | A-133504 | UfsusUfaUfuUfcAfaAfcfaaAfgCfcCfacCfaAfL96 | 1338 | A-133506 | usUfsgUfgGfcCfuUfguuGfaAfaUfaAfasasg | 1398 |
| AD-66742 | A-133508 | GfscsUfggGfaGfaUfgGfUfaUfuGfccGfcAfcAfL96 | 1339 | A-133510 | usGfsuGfcGfcAfUfacaUfcUfcCfaGfcscsu | 1399 |
| AD-66743 | A-133512 | GfsgsGfuAfuGfgCfUfCfcAfgCfaGfucCfgAfL96 | 1340 | A-133513 | usCfsgAfcUfgCfuGfgagCfcAfuAfcCfcsusg | 1400 |
| AD-66744 | A-133514 | CfsusGfgAfgAfugGfuAfuUfgCfgCfaCfcAfL96 | 1341 | A-133515 | usGfsgUfgCfgCfaAfuacAfuCfuCfcAfgsgsc | 1401 |
| AD-66745 | A-133516 | GfsaaAfgAfuGfcAfcCfaUfgUfcCfuAfL96 | 1342 | A-133517 | usAfsgGfacAfuGfGfuguGfcAfuCfuUfcsasc | 1402 |
| AD-66746 | A-133477 | GfsasAfgAfuGfcfucfuUfcCfAfgUfuCfgUfgUfgUfL96 | 1343 | A-133479 | asCfsaCfaCfgAfaCfugaAfgAfgCfaUfcscsa | 1403 |
| AD-66747 | A-133481 | UfsgsGfaUfgCfctuCfAfgUfuCfgUfgUfgUfL96 | 1344 | A-133483 | asCfsaCfafaCfugGfaagAfgCfaUfcfascsc | 1404 |
| AD-66748 | A-133485 | GfsgsUfggGfaUfgGfaUfgGfctuUfcAfgUfuCfgUfL96 | 1345 | A-133487 | asCfsgAfaCfugGfaAfgAfagCfaUfcCfaCfcsasg | 1405 |
| AD-66749 | A-133489 | UfsggsAfgCfuGfgUfgGfaUfgGfctuUfcAfgUfL96 | 1346 | A-133491 | usGfsaaAfgAfgCfaUfcfcaCfcAfcCfcfuCfasgsc | 1406 |
| AD-66750 | A-133493 | GfscsUfgGfgAfgAfUfgGfcUfcfunCfaGfuUfL96 | 1347 | A-133495 | asAfscUfgAfaAfgCfaUfcCfaCfcAfgCfcsusc | 1407 |
| AD-66751 | A-133497 | GfsgsAfugGfcUfcUfUfcfAfgGfuGfcUfgGfuAfL96 | 1348 | A-133499 | usAfsAfcfAfgGfcAfafcUfgaaGfaGfcAfuCfcsasc | 1408 |
| AD-66752 | A-133501 | CfsusGfugFfgAfuCfcfuUfAfgUfcAfgUfuAfL96 | 1349 | A-133503 | asGfsaAfgCfAfucCfafcGfcUfcAfgCfcscsc | 1409 |
| AD-66753 | A-133505 | GfsgsCfuGfaGfcUfgGfgFfuGfaUfgCfuCfuUfaAfL96 | 1350 | A-133507 | usAfsaGfaGfcAfucCfacCfaGfcUfcAfgscsc | 1410 |
| AD-66754 | A-133509 | CfsusGfaGfcUfgGfgFfuGfaUfgCfuUfL96 | 1351 | A-133511 | usAfsaGfaGfcAfucUfcacCfaCfcAfaUfgscsc | 1411 |
| AD-66755 | A-133518 | CfsasUfuGfuGfaUfgGfaUfgGfctuUfL96 | 1352 | A-133519 | asAfsgGfaUfcGfauCfafcAfcAfaUfgscsc | 1412 |
| AD-66756 | A-133520 | AfsgsAfuAfcAfcUfUfCfaAfcAfaAfgCfcfCfaAfL96 | 1353 | A-133521 | asAfsgGfaUfcGfauGfuGfuAfuCfususu | 1413 |
| AD-66757 | A-133522 | UfsgsGfaUfgAfuGfuGfcUfCfcGfuCfcGfaFfL96 | 1354 | A-133523 | usCfscsGfaAfaGfaCfacCfucCfaUfCfascsa | 1414 |
| AD-66758 | A-133524 | UfsgsUfuGfcUfuCfcGfaGfcUfuGfaUfcfCfaAfL96 | 1355 | A-133525 | asUfscAfcAfgCfcfggAfgAfcAfaCfascsu | 1415 |
| AD-66759 | A-133526 | GfscsUfuFfuAfcUfUfCfaAfcAfaAfgCfcCfcfaAfL96 | 1356 | A-133527 | usGfsgGfcCfuGfuUfgaaGfuAfaAfgCfcscsc | 1416 |
| AD-66760 | A-133528 | AfsusGfaGfuAfgFfuuGfctUfGfcCfuUfL96 | 1357 | A-133529 | asGfscCfuCfcGfaAfgCfaAfcAfcAfuscsc | 1417 |
| AD-66761 | A-133530 | CfsasCfaCfuGfacCfafAfuGfcfCfcCfaAfgGfaCfuUfL96 | 1358 | A-133531 | asGfscCfuUfgGfcGfaugUfcAfgUfgGfgsgsc | 1418 |

TABLE 11-continued

Modified Sense and Antisense Sequences of IGF-1

| Duplex Name | Sense Oligo Name | Modified Sense Sequence | SEQ ID NO | Antisense Oligo Name | Modified Antisense Sequence | SEQ ID NO: |
|---|---|---|---|---|---|---|
| AD-66762 | A-133532 | GfscsUfaUfgGfcUfCfcGfaGfcAfuUfcGfgAfL96 | 1359 | A-133533 | usCfscGfaAfuGfcUfggaGfccCfauGfaGfcscsu | 1419 |
| AD-66763 | A-133534 | AfsasGfaUfaCfaCfAfUfcAfuCfgCfguCfguUfcUfL96 | 1360 | A-133535 | asGfsaCfgAfcAfuGfaugUfgUfaUfcUfususa | 1420 |
| AD-66764 | A-133536 | UfsusGfcUfcUfcGfGfAfaGfcUfGfuGfuGfaUfcUfL96 | 1361 | A-133537 | asGfsaUfcAfcAfgCfuccGfgAfaGfcAfascsa | 1421 |
| AD-66765 | A-133538 | UfscsCfgGfaGfcUfGfUfgAfuCfguCfuUfcCfgAfL96 | 1362 | A-133539 | usCfscUfcAfgAfuCfacaGfcUfcCfgGfasasg | 1422 |
| AD-66766 | A-133540 | GfsusGfaAfuGfaGfUfGfuUfgCfuUfcCfgAfL96 | 1363 | A-133541 | usCfsgGfaAfgCfaAfcacUfCfAfuCfcAfcsasa | 1423 |
| AD-66767 | A-133542 | UfsasCfaCfaUfcAfUfGfuCfgUfcUfuCfaAfL96 | 1364 | A-133543 | usUfsgAfaGfaCfgAfcauGfaUfgUfasusc | 1424 |
| AD-66768 | A-133544 | AfsasAfgAfuAfcAfCfAfuCfaUfgUfcGfuAfL96 | 1365 | A-133545 | usAfscGfaCfaUfgAfuguGfuAfuCfuUfusasu | 1425 |
| AD-66769 | A-133546 | GfsgsCfuAfuGfgCfUfCfcAfgCfaUfuCfgAfL96 | 1366 | A-133547 | usCfsgAfaUfgCfuGfgagCfcAfuAfgCfcsusg | 1426 |
| AD-66770 | A-133548 | AfscsAfcUfgAfcAfUfGfcCfcAfaCfafuAfL96 | 1367 | A-133549 | usAfsgUfcUfuGfgGfcauGfucfagfuGfusgsg | 1427 |
| AD-66771 | A-133550 | AfsggUfgUfugGfcUfUfCfcGfgAfgCfuGfuAfL96 | 1368 | A-133551 | usAfscAfgCfucCfcGfaaGfcAfaCfacCfuscsa | 1428 |
| AD-66772 | A-133552 | GfsasGfaCfcCfuUfUfGfcGfgGfguCfuGfaAfL96 | 1369 | A-133553 | usUfscAfgCfcCfcGfcaaAfgGfgUfcUfcsusg | 1429 |
| AD-66773 | A-133554 | AfscsUfgAfcAfUfgCfcCfcaAfaCfuCfaAfL96 | 1370 | A-133555 | usUfsgAfgUfcUfuGfgcAfuGfucAfgfusgsu | 1430 |
| AD-66774 | A-133556 | GfsasUfacCfaCfaUfCfAfuGfcUfcUfcAfL96 | 1371 | A-133557 | usAfsaGfaCfgAfcAfugaUfgUfgUfaUfcsusu | 1431 |
| AD-66775 | A-133558 | AfsasGfcCfcAfcAfgfGfcAfgfGfcUfcAfL96 | 1372 | A-133559 | usGfsaGfcCfaUfaGfccuGfugGfgfCfusgsu | 1432 |

Example 6-Knockdown of IGF-1 Expression with an IGF-1 siRNA Decreases Expression of IGF-1

A series of siRNAs targeting mouse IGF-1 were designed and tested for the ability to knockdown expression of IGF-1 mRNA in 6-8 week old C57B1/6 female mice. Duplexes were selected for further optimization using chemical modifications. Analysis for IGF-1 knockdown in mice using the same assay identified the AD-68112 duplex (sense sequence gsasuacaCfaUfCfAfugucgucuuaL96 (SEQ ID NO:1433); antisense sequence usAfsagaCfgAfCfaugaUfgUfguaucsusu (SEQ ID NO: 1434), based on the sequence of the AD-66774 duplex, for use in further studies.

A single 3 mg/kg or 10 mg/kg dose of AD-68112; or PBS control, was administered subcutaneously on day 0 to 6-8 week old C57B1/6 female mice (n=3 per group). On days 7, 14, and 21 the mice were sacrificed to assess knockdown of IGF-1 mRNA in liver by qPCR.

AD-68112 was found to be effective in decreasing expression of IGF-1 mRNA. The results are shown in the table below. Results are expressed as mRNA levels relative to control.

| Dose | Day 7 | Day 14 | Day 21 |
| --- | --- | --- | --- |
| 3 mg/kg | 7.4 | 17.8 | 33.3 |
| 10 mg/kg | 3.4 | 7.4 | 12.7 |

In a separate study, a decrease in serum IGF-1 was observed in 6-8 week old C57B1/6 female mice (n=3) response to treatment with AD-68112 in a single dose of 3 mg/kg. Specifically, AD-68112 decreased the serum IGF-1 protein level to about 17%, 70%, and 55% on days 7, 14, and 21, respectively.

Further, in a dose-response study, AD-68112 was demonstrated to be effective in knocking down the expression of IGF-1 mRNA in the liver in a dose-response manner. Specifically, C57B1/6 female mice, 6-8 weeks of age (n=3 per group) were administered a single 0.3 mg/kg, 1 mg/kg, 3 mg/kg, or 10 mg/kg AD-68112 at; or a PBS control. IGF-1 serum protein level reduction was observed in a dose response manner.

Example 7-Knockdown of IGFALS and IGF-1 Expression with IGFALS and IGF-1 siRNAs Alone and in Combination A series of siRNAs targeted each to mouse IGFALS (AD-66807, sense sequence, ascsagauGfaGfCfUfcagcgucuuuL96, SEQ ID NO: 1435; and antisense sequence asAfsagaCfgCfUfgagcUfcAfucugusgsu, SEQ ID NO:1436) and mouse IGF-1 (AD-68112) were tested for the ability to knockdown expression of IGFALS and IGF-1 mRNA and protein expression in 6-8 week old C57B1/6 female mice, either alone or in combination.

Weekly 3 mg/kg doses of AD-66807 and AD-68112, either alone or in combination; or PBS control, were administered to 4 week old C57B1/6 female mice (n=8 per group) subcutaneously starting at day 0 for 8 weeks. On day 58 or 59, the mice were sacrificed to assess knockdown of IGFALS and IGF-1 mRNA in liver by qPCR. Serum IGFALS levels were assayed by western blot and serum IGF-1 levels were assayed by ELISA.

AD-66807 and AD-68112 were found to be effective in decreasing expression of IGFALS and IGF-1 mRNA and protein. The results are shown in the tables below. RNA and protein levels are expressed as levels relative to control.

IGFALS and IGF-1 mRNA Levels Relative to Control

| Treatment | IGFALS | IGF-1 |
| --- | --- | --- |
| Control (PBS) | 1.16 | 1.05 |
| SiRNA-IGFALS (3 mg/kg) | 0.11 | 1.10 |
| SiRNA-IGF-1 (3 mg/kg) | 0.70 | 0.03 |
| SiRNA-ALS (3 mg/kg) + IGF-1 (3 mg/kg) | 0.09 | 0.05 |

IGFALS and IGF-1 Protein Levels Relative to Control.

| Treatment | IGFALS | IGF-1 |
| --- | --- | --- |
| Control (PBS) | 1.0 | 1.0 |
| SiRNA-IGFALS (3 mg/kg) | 0.03 | 0.26 |
| SiRNA-IGF-1 (3 mg/kg) | 0.61 | 0.13 |
| SiRNA-ALS (3 mg/kg) + IGF-1 (3 mg/kg) | 0.01 | 0.05 |

A dose response study was performed. AD-66807 and AD-68112 were subcutaneously administered to 6-8 week old C57B1/6 female mice (n=3 per group) at 0.3 mg/kg, 1 mg/kg, 3 mg/kg, and 10 mg/kg, either alone or in combination; or PBS control starting at day 0. On day 14, the mice were sacrificed to assess knockdown of IGFALS and IGF-1 mRNA in liver by qPCR. Serum IGF-1 levels were assayed by ELISA.

AD-66807 and AD-68112 were found to be effective in decreasing expression of serum IGF-1 protein. The results are shown in the table below. Protein levels are expressed as levels relative to control.

Serum IGF-1 Protein Levels Relative to Control at Day 7.

| Treatment | 0 mg/kg | 0.3 mg/kg | 1.0 mg/kg | 3.0 mg/kg | 10.0 mg/kg |
| --- | --- | --- | --- | --- | --- |
| SiRNA-IGFALS | 100 | 0.81 | 0.54 | 0.37 | 0.31 |
| SiRNA-IGF-1 | 100 | 1.13 | 0.83 | 0.52 | 0.49 |
| SiRNA-IGFALS + SiRNA-IGF-1 | 100 | 0.61 | 0.34 | 0.14 | 0.06 |

Example 8-Knockdown of IGFALS and IGF-1 Expression with IGFALS and IGF-1 siRNAs Alone and in Combination in a Transgenic Mouse Expressing Bovine Growth Hormone Similar knockdown of serum IGFALS and IGF-1 levels were observed in a transgenic mouse that constitutively expresses bovine growth hormone and recapitulates some of the features of acromegaly (Olsson et al, Am J Physiol Endocrinol Metab. 2003; 285:E504-11). Specifically, AD-66807 and AD-68112 were demonstrated to decrease serum levels of IGF-1 protein. At least a trend in decreased weight gain was observed in male mice treated with either AD-66807 or AD-68112 alone, and in female mice treated with a combination of AD-66807 and AD-68112.

Example 9-IGFALS Transcripts, siRNA Design, and siRNA Screening

A set of siRNAs targeting the human IGFALS, "insulin like growth factor binding protein acid labile subunit" (human: NCBI refseqID NM_004970 (SEQ ID NO: 1); NCBI GeneID: 3483), as well as toxicology-species IGFALS orthologs (cynomolgus monkey: XM_005590898) were designed using custom R and Python scripts. The human NM_004970 REFSEQ mRNA, version 2, has a length of 2168 bases.

The rationale and method for the set of siRNA designs is as follows: the predicted efficacy for every potential 19mer siRNA from position 10 through the end was determined with a linear model derived the direct measure of mRNA knockdown from more than 20,000 distinct siRNA designs targeting a large number of vertebrate genes. Subsets of the IGFALS siRNAs were designed with perfect or near-perfect matches between human and cynomolgus monkey. For each strand of the siRNA, a custom Python script was used in a brute force search to measure the number and positions of mismatches between the siRNA and all potential alignments in the target species transcriptome. Extra weight was given to mismatches in the seed region, defined here as positions 2-9 of the antisense oligonucleotide, as well the cleavage site of the siRNA, defined here as positions 10-11 of the antisense oligonucleotide. The relative weight of the mismatches was 2.8; 1.2:1 for seed mismatches, cleavage site, and other positions up through antisense position 19. Mismatches in the first position were ignored. A specificity score was calculated for each strand by summing the value of each weighted mismatch. Preference was given to siRNAs whose antisense score in human was >=2.2 and predicted efficacy was >=50% knockdown of the transcript.

In Vitro Dual-Glo® Screening

Cell Culture and Transfections

Cos 7 cells (ATCC, Manassas, Va.) were grown to near confluence at 37° C. in an atmosphere of 5% $CO_2$ in DMEM (ATCC) supplemented with 10% FBS, before being released from the plate by trypsinization. Human IGFALS (NM_004970 (SEQ ID NO:1) was cloned into the psicheck2 vector to generate the Dual-Glo® Luciferase construct. The Dual-luciferase plasmid was co-transfected with siRNA into 5000 cells using Lipofectamine RNAiMax (Invitrogen, Carlsbad Calif. cat #13778-150). For each well of a 384 well plate, 0.1 µl of Lipofectamine was added to 5 ng of plasmid vector and siRNA in 15 µl of Opti-MEM and allowed to complex at room temperature for 15 minutes. The mixture was then added to the cells resuspended in 35 ul of fresh complete media. Cells were incubated for 48 hours before luciferase was measured. Screens were performed at 10 nM and 0.1 nM final duplex concentration.

Dual-Glo® Luciferase Assay

Forty-eight hours after the siRNAs were transfected, Firefly (transfection control) and *Renilla* (fused to IGFALS target sequence in 3' UTR) luciferase were measured. First, media was removed from cells. Then Firefly luciferase activity was measured by adding 20 ul of Dual-Glo® Luciferase Reagent mixed with 20 ul of complete media to each well. The mixture was incubated at room temperature for 30 minutes before luminescense (500 nm) was measured on a Spectramax (Molecular Devices) to detect the Firefly luciferase signal. *Renilla* luciferase activity was measured by adding 20 ul of room temperature of Dual-Glo® Stop & Glo® Reagent to each well and the plates were incubated for 20 minutes before luminescence was again measured to determine the *Renilla* luciferase signal. The Dual-Glo® Stop & Glo® Reagent quenched the firefly luciferase signal and sustained luminescence for the *Renilla* luciferase reaction. siRNA activity was determined by normalizing the *Renilla* (IGFALS) signal to the Firefly (control) signal within each well. The magnitude of siRNA activity was then assessed relative to cells that were transfected with the same vector but were not treated with siRNA or were treated with a non-targeting siRNA. All transfections were done in quadruplicates.

TABLE 12

Unmodified Sense and Antisense Strand Sequences of IGFALS dsRNAs

| Duplex Name | Sense Oligo Name | Sense Sequence | Position in NM_004970.2 | SEQ ID NO | Antisense Oligo Name | Antisense Sequence | Position in NM_004970.2 | SEQ ID NO |
|---|---|---|---|---|---|---|---|---|
| AD-76171 | A-152158 | CAAUUAAAGGCAAAGGCAAUA | 2058-2078 | 1437 | A-152159 | UAUUGCCUUUGCCUUUAAUUGAU | 2056-2078 | 1484 |
| AD-76172 | A-152160 | ACACCUACAACAACAUCACCA | 1808-1828 | 1438 | A-152161 | UGGUGAUGUUGUUGUAGGUGUAC | 1806-1828 | 1485 |
| AD-76173 | A-152162 | UACACCUACAACAACAUCACA | 1807-1827 | 1439 | A-152163 | UGUGAUGUUGUUGUAGGUGUACG | 1805-1827 | 1486 |
| AD-76174 | A-152164 | CAUCAAGGCAAACGUGUUCGA | 777-797 | 1440 | A-152165 | UCGAACACGUUUGCCUUGAUGGC | 775-797 | 1487 |
| AD-76175 | A-152166 | CACCUACAACAACAUCACCUA | 1809-1829 | 1441 | A-152167 | UAGGUGAUGUUGUUGUAGGUGUA | 1807-1829 | 1488 |
| AD-76176 | A-152168 | CGUACACCUACAACAACAUCA | 1805-1825 | 1442 | A-152169 | UGAUGUUGUUGUAGGUGUACGCG | 1803-1825 | 1489 |
| AD-76177 | A-152170 | GUACACCUACAACAACAUCAA | 1806-1826 | 1443 | A-152171 | UUGAUGUUGUUGUAGGUGUACGC | 1804-1826 | 1490 |
| AD-76178 | A-152172 | GACACCUUCUCAGGACAACA | 1322-1342 | 1444 | A-152173 | UGUGUUCCUUGAGGAAGAGUCGG | 1320-1342 | 1491 |
| AD-76179 | A-152174 | AGCCUUCUCAGAACCUCUCCAA | 357-377 | 1445 | A-152175 | UUGGAGAGGUUCUGGAAGGCUGC | 355-377 | 1492 |
| AD-76180 | A-152176 | UCACGCUAGACCACACCAGA | 1109-1129 | 1446 | A-152177 | UCUGGUGUGGUCUAGCGUGAGC | 1107-1129 | 1493 |
| AD-76181 | A-152178 | UGGACGUCUGCACAACCGCA | 1541-1561 | 1447 | A-152179 | UGCGGUUGUGCGAGACGUCCAGC | 1539-1561 | 1494 |
| AD-76182 | A-152180 | ACCUGGACCGCAACCUCAUCA | 824-844 | 1448 | A-152181 | UGAUGAGGUUGCGGUCCAGGUAG | 822-844 | 1495 |
| AD-76183 | A-152182 | UGGACCUGUCCCACAACCGCA | 893-913 | 1449 | A-152183 | UGCGGUUGUGGGACAGGUCCAGC | 891-913 | 1496 |
| AD-76184 | A-152184 | UGCGGCUGUCCCACAACGCCA | 965-985 | 1450 | A-152185 | UGGCGUUGUGGGACAGCCGCAGC | 963-985 | 1497 |
| AD-76185 | A-152186 | CGCUCGGCCUCAGCAACAACA | 530-550 | 1451 | A-152187 | UGUUGUUGCUGAGGCCGAGCGAG | 528-550 | 1498 |
| AD-76186 | A-152188 | CCUCAGGAACAACUCACUGCA | 1617-1637 | 1452 | A-152189 | UGCAGUGAGUUGUUCCUGAGGCU | 1615-1637 | 1499 |
| AD-76187 | A-152190 | CUGCGGACCUUCACGCCGCAA | 1633-1653 | 1453 | A-152191 | UUGCGGCGUGAAGGUCCGCAGUG | 1631-1653 | 1500 |
| AD-76188 | A-152192 | CCUCUCUGGGAACUGUCUCA | 1185-1205 | 1454 | A-152193 | UGGAGACAGUUCCCAGAGAGGUU | 1183-1205 | 1501 |
| AD-76189 | A-152194 | GCUCUCCCGCAACCGCCUGGA | 1473-1493 | 1455 | A-152195 | UCCAGGCGGUUGCGGGGAGACAG | 1471-1493 | 1502 |
| AD-76190 | A-152196 | CGUCUCGCACAACCGCCUGGA | 1545-1565 | 1456 | A-152197 | UCCAGGCGGUUGUGCGAGACGUC | 1543-1565 | 1503 |
| AD-76191 | A-152198 | CACGCUAGACCACACCAGCA | 1110-1130 | 1457 | A-152199 | UGCUGGUGUGGUCUAGCGUGAG | 1108-1130 | 1504 |
| AD-76192 | A-152200 | UGCUCUCCCGCAACCGCCUGA | 1472-1492 | 1458 | A-152201 | UCAGGCGGUUGCGGGAGAGCAGC | 1470-1492 | 1505 |
| AD-76193 | A-152202 | ACCUCAGCCUCAGGAACAACA | 1610-1630 | 1459 | A-152203 | UGUUGUUCCUGAGGCUGAGGUAG | 1608-1630 | 1506 |

TABLE 12-continued

Unmodified Sense and Antisense Strand Sequences of IGFALS dsRNAs

| Duplex Name | Sense Oligo Name | Sense Sequence | Position in NM_004970.2 | SEQ ID NO | Antisense Oligo Name | Antisense Sequence | Position in NM_004970.2 | SEQ ID NO |
|---|---|---|---|---|---|---|---|---|
| AD-76194 | A-152204 | CACCUUCAAGGACCUGCACUA | 1005-1025 | 1460 | A-152205 | UAGUGCAGGUCCUUGAAGGUGCG | 1003-1025 | 1507 |
| AD-76195 | A-152206 | GGCCUCGUGGGCAUUGAGGAA | 1342-1362 | 1461 | A-152207 | UUCCUCAAUGCCCACGAGGCCGU | 1340-1362 | 1508 |
| AD-76196 | A-152208 | ACCUUCAAGGACCUGCACUUA | 1006-1026 | 1462 | A-152209 | UAAGUGCAGGUCCUUGAAGGUGC | 1004-1026 | 1509 |
| AD-76197 | A-152210 | GGCCUUCUGGCUGGACGUCUA | 1530-1550 | 1463 | A-152211 | UAGACGUCCAGCCAGAAGGCCCG | 1528-1550 | 1510 |
| AD-76198 | A-152212 | GGCAUUGAGGAGCAGAGCCUA | 1351-1371 | 1464 | A-152213 | UAGGCUCUGCUCCUCAAUGCCCA | 1349-1371 | 1511 |
| AD-76199 | A-152214 | GCCUUCCAGAACCUCUCCAGA | 358-378 | 1465 | A-152215 | UCUGGAGAGGUUCUGGAAGGCUG | 356-378 | 1512 |
| AD-76200 | A-152216 | GCCGUCAUGAACCUCUCUGGA | 1174-1194 | 1466 | A-152217 | UCCAGAGAGGUUCAUGACGGCCA | 1172-1194 | 1513 |
| AD-76201 | A-152218 | AGGCUGGAGGACGGGCUCUUA | 559-579 | 1467 | A-152219 | UAAGAGCCCGUCCUCCAGCCUGC | 557-579 | 1514 |
| AD-76202 | A-152220 | CUCUACCUGGACCCCAACCUA | 820-840 | 1468 | A-152221 | UAGGUUGGGGUCCAGGUAGAGUU | 818-840 | 1515 |
| AD-76203 | A-152222 | GCGGAUGAGCUCAGCGUCUUA | 238-258 | 1469 | A-152223 | UAAGACGCUGAGCUCAUCCGCGU | 236-258 | 1516 |
| AD-76204 | A-152224 | CCGUCUGAGCAGGCUGGAGGA | 549-569 | 1470 | A-152225 | UCCUCCAGCCUGCUCAGACGGUU | 547-569 | 1517 |
| AD-76205 | A-152226 | GGUCAUGAAACCUCUCUGGGAA | 1176-1196 | 1471 | A-152227 | UUCCCAGAGAGGUUCAUGACCGC | 1174-1196 | 1518 |
| AD-76206 | A-152228 | CUGCAGCUGGGCCACAACCGA | 1036-1056 | 1472 | A-152229 | UCGGUUGUGGCCCAGCUGCAGCU | 1034-1056 | 1519 |
| AD-76207 | A-152230 | CGGGAGCUGGACCUGAGCAGA | 742-762 | 1473 | A-152231 | UCUGCUCAGGUCCAGUCCCCGGA | 740-762 | 1520 |
| AD-76208 | A-152232 | CCGCCUGUGUCUGCAGCUACA | 209-229 | 1474 | A-152233 | UGUAGCUGCAGACACAGGCGGCC | 207-229 | 1521 |
| AD-76209 | A-152234 | UCUUCUGCAGCUCCAGGAACA | 254-274 | 1475 | A-152235 | UGUUCCUGGAGCUGCAGAAGACG | 252-274 | 1522 |
| AD-76210 | A-152236 | CUGGCUGAGCGCAGCUUUGAA | 1066-1086 | 1476 | A-152237 | UUCAAAGCUGCGCUCAGCCAGCU | 1064-1086 | 1523 |
| AD-76211 | A-152238 | CUCGACCUGACUCCAACCAA | 1396-1416 | 1477 | A-152239 | UUGGUUGGAGGUCAGGUCGAGCU | 1394-1416 | 1524 |
| AD-76212 | A-152240 | CUCAACCUCGGCUGGAAUAGA | 604-624 | 1478 | A-152241 | UCUAUUCCAGCCGAGGUUGAGGU | 602-624 | 1525 |
| AD-76213 | A-152242 | GCCUAGAGAACCUGUGCCACA | 440-460 | 1479 | A-152243 | UGUGGCACAGGUUCUCUAGGCCC | 438-460 | 1526 |
| AD-76214 | A-152244 | CAGCUUGGAGUGCUCACCGUA | 1096-1116 | 1480 | A-152245 | UAGCGUGAGCACCUCAAGCUGCC | 1094-1116 | 1527 |
| AD-76215 | A-152246 | CAGGUCCUCAGUGUCCUCCAGA | 1961-1981 | 1481 | A-152247 | UCUGGAGGACACUGAGGACCUGUC | 1959-1981 | 1528 |

TABLE 12-continued

Unmodified Sense and Antisense Strand Sequences of IGFALS dsRNAs

| Duplex Name | Sense Oligo Name | Sense Sequence | Position in NM_ 004970.2 | SEQ ID NO | Antisense Oligo Name | Antisense Sequence | Position in NM_ 004970.2 | SEQ ID NO |
|---|---|---|---|---|---|---|---|---|
| AD-76216 | A-152248 | GCUGCGAUGGCUGGACCUGUA | 882-902 | 1482 | A-152249 | UACAGGUCCAGCCAUCGCAGCGC | 880-902 | 1529 |
| AD-76217 | A-152250 | GGCAAGCUGGAGUACCUGCUA | 1453-1473 | 1483 | A-152251 | UAGCAGGUACUCCAGCUUGCCCA | 1451-1473 | 1530 |

TABLE 13

IGFALS in vitro 10 nM and 0.1 nM screen

| Duplex Name | 10 nM AVG | 10 nM STD | 0.1 nM AVG | 0.1 nM STD | Position in NM_004970.2 |
|---|---|---|---|---|---|
| AD-76171 | 29.9 | 0.1 | 55.8 | 5.4 | 2058-2078 |
| AD-76172 | 42.7 | 2.3 | 101.9 | 7.8 | 1808-1828 |
| AD-76173 | 32.8 | 3.1 | 81.2 | 7.1 | 1807-1827 |
| AD-76174 | 45.3 | 10.5 | 86.2 | 9.7 | 777-797 |
| AD-76175 | 42.8 | 7.6 | 97.3 | 8.7 | 1809-1829 |
| AD-76176 | 69 | 5.8 | 93.9 | 11.3 | 1805-1825 |
| AD-76177 | 53.6 | 11 | 99.2 | 15.8 | 1806-1826 |
| AD-76178 | 72.6 | 4.9 | 92.6 | 6.9 | 1322-1342 |
| AD-76179 | 80.1 | 8.2 | 113.3 | 8 | 357-377 |
| AD-76180 | 132 | 13.9 | 124.2 | 16.8 | 1109-1129 |
| AD-76181 | 67.1 | 5.9 | 99.1 | 0.3 | 1541-1561 |
| AD-76182 | 110.4 | 17.9 | 102 | 5.1 | 824-844 |
| AD-76183 | 69.8 | 9.9 | 100.3 | 6.9 | 893-913 |
| AD-76184 | 62 | 6.3 | 99.4 | 7.1 | 965-985 |
| AD-76185 | 119.5 | 33.1 | 92.8 | 4.4 | 530-550 |
| AD-76186 | 52.4 | 4.6 | 94.7 | 2.7 | 1617-1637 |
| AD-76187 | 116.7 | 6.4 | 117.7 | 9.4 | 1633-1653 |
| AD-76188 | 60.4 | 5.8 | 106.2 | 4.8 | 1185-1205 |
| AD-76189 | 89.9 | 2.1 | 102.9 | 8.4 | 1473-1493 |
| AD-76190 | 83.5 | 3.5 | 104.5 | 6.5 | 1545-1565 |
| AD-76191 | 80.9 | 3.3 | 96.4 | 7.2 | 1110-1130 |
| AD-76192 | 93.9 | 3.9 | 103 | 5.4 | 1472-1492 |
| AD-76193 | 99.3 | 3.5 | 95.1 | 10.2 | 1610-1630 |
| AD-76194 | 192.1 | 4.9 | 118 | 12.1 | 1005-1025 |
| AD-76195 | 86.1 | 3.3 | 106.7 | 8.4 | 1342-1362 |
| AD-76196 | 184 | 23.4 | 114.8 | 6.7 | 1006-1026 |
| AD-76197 | 55.3 | 4.4 | 111.4 | 14.2 | 1530-1550 |
| AD-76198 | 66.7 | 3.6 | 97.1 | 13.1 | 1351-1371 |
| AD-76199 | 54.5 | 2 | 91.8 | 4.2 | 358-378 |
| AD-76200 | 63.9 | 10.1 | 88 | 10.6 | 1174-1194 |
| AD-76201 | 150.6 | 4.6 | 113.6 | 18.3 | 559-579 |
| AD-76202 | 64.7 | 1.4 | 95.7 | 13.7 | 820-840 |
| AD-76203 | 41.3 | 1.7 | 93 | 2.1 | 238-258 |
| AD-76204 | 67.5 | 6.9 | 101.3 | 3.6 | 549-569 |
| AD-76205 | 73.1 | 9.5 | 87.6 | 7.8 | 1176-1196 |
| AD-76206 | 86.4 | 3.7 | 107.7 | 17 | 1036-1056 |
| AD-76207 | 131.4 | 22.4 | 99.7 | 10.5 | 742-762 |
| AD-76208 | 46.5 | 12 | 103 | 13.2 | 209-229 |
| AD-76209 | 43.8 | 5.2 | 98.1 | 13.9 | 254-274 |
| AD-76210 | 41.6 | 7.3 | 94.4 | 6 | 1066-1086 |
| AD-76211 | 152.3 | 9.4 | 125.1 | 3.4 | 1396-1416 |
| AD-76212 | 59.2 | 12.7 | 82.3 | 23.4 | 604-624 |
| AD-76213 | 71.1 | 4.9 | 94.9 | 11.6 | 440-460 |
| AD-76214 | 109.8 | 5.9 | 102.8 | 8.4 | 1096-1116 |
| AD-76215 | 70.2 | 7.5 | 103.2 | 25.4 | 1961-1981 |
| AD-76216 | 62.8 | 9.5 | 107.7 | 15.1 | 882-902 |
| AD-76217 | 68.8 | 1.7 | 94.5 | 2.4 | 1453-1473 |
| Mock | 117.3 | 16.3 | 106.9 | 9.5 | |

TABLE 14

Modified Sense and Antisense Strand Sequences of IGFALS dsRNAs

| Duplex Name | Sense Oligo Name | Sense Oligo Sequence | SEQ ID NO | Antisense Oligo Name | Antisense Oligo Sequence | SEQ ID NO | mRNA target sequence | SEQ ID NO |
|---|---|---|---|---|---|---|---|---|
| AD-76171 | A-152158 | csasauuaAfaGfGfCfaaaggcaauaL96 | 1531 | A-152159 | VPusAfsuugCfcUfufugccUfuUfaauugsasu | 1578 | AUCAAUUAAAGGCAAAGGCAAUC | 1625 |
| AD-76172 | A-152160 | ascsaccuuAfcAfAfCfaacaacaccaL96 | 1532 | A-152161 | VPusGfsgugAfuGfUfuguuGfuAfggugusasc | 1579 | GUACACCUACAACAACACCACCU | 1626 |
| AD-76173 | A-152162 | usascaccUfacAfCfAfAfcaacaucaccaL96 | 1533 | A-152163 | VPusGfsugaUfgUfUfguugUfaGfuguascsg | 1580 | CGUACACCUACAACAACAUCACC | 1627 |
| AD-76174 | A-152164 | csasucaaGfgCfAfAfAfcguguucgaL96 | 1534 | A-152165 | VPusCfsgaaCfacGfuuugCfcUfugaugsgsc | 1581 | GCCAUCAAGGCAAACGUGUUCGU | 1628 |
| AD-76175 | A-152166 | csasccuaCfaAfCfAfAfacaucaccuaL96 | 1535 | A-152167 | VPusAfsgguGfaUfGfuuguUfGfaggugsusa | 1582 | UACACCUACAACAACAUCACCUG | 1629 |
| AD-76176 | A-152168 | csgguacaCfcUfAfCfaacaacaucaL96 | 1536 | A-152169 | VPusGfsaugUfuGfUfuguaGfgUfguacgscsg | 1583 | CGCGUACACCUACAACAACAUCA | 1630 |
| AD-76177 | A-152170 | gsusacacCfuaAfCfAfacaacaucaaL96 | 1537 | A-152171 | VPusUfsgauGfuuGfUfuuguAfgGfuguacsgsc | 1584 | GCGUACACCUACAACAACAUCAC | 1631 |
| AD-76178 | A-152172 | gsasacacUfccCfUfCfaaggacaacaL96 | 1538 | A-152173 | VPusGfsuugUfcCfUfugagGfuAfagacsssg | 1585 | CCGACUUCCUCCAAGGACAACAG | 1632 |
| AD-76179 | A-152174 | asgscuucUfcCfAfGfAfaccucuccaaL96 | 1539 | A-152175 | VPusUfsggaGfaGfGfuucuGfaAfaggcusgsc | 1586 | GCAGCCUUCCAGAACCUCUCCAG | 1633 |
| AD-76180 | A-152176 | uscscacgCfuaGfAfCfcacaacagaL96 | 1540 | A-152177 | VPusCfsuggUfuGfGfugucUfaGfcgugasgsc | 1587 | GCUCACGCUAGACCACAACCAGC | 1634 |
| AD-76181 | A-152178 | usgsgacgUfcUfCfGfcacaaccgcaL96 | 1541 | A-152179 | VPusGfscggUfuGfUfgcgaGfaCfguccasgsc | 1588 | GCUGGACGUCUGCACAACCGCC | 1635 |
| AD-76182 | A-152180 | ascscuggAfcCfGfCfCfaaccucaucaL96 | 1542 | A-152181 | VPusGfsaugAfgGfGfuucgGfuCfcaggusasg | 1589 | CUACCUGGACCCGAACCUCAUCG | 1636 |
| AD-76183 | A-152182 | usgsgaccUfgUfCfCfcaaccgcaL96 | 1543 | A-152183 | VPusGfscggUfuGfUfgggaCfaGfguccasgsc | 1590 | GCUGGACCUGUCCCACAACCGCG | 1637 |
| AD-76184 | A-152184 | usgscgggCfugUfCfCfcacaacgccaL96 | 1544 | A-152185 | VPusGfsgcgUfuGfCfuggaCfaGfccgcasgsc | 1591 | GCUGCGGCUGUCCCAGAACGCCA | 1638 |
| AD-76185 | A-152186 | csgscuggGfccUfUfCfagcaacaacaL96 | 1545 | A-152187 | VPusGfsuugUfuGfCfugagGfcCfagcgsasg | 1592 | CUCGCUGCGGCCCUCAGCAACAC | 1639 |
| AD-76186 | A-152188 | cscscucagGfaaAfCfAfacucacugcaL96 | 1546 | A-152189 | VPusGfscagUfgAfGfuuguUfcCfugaggscsu | 1593 | AGCCUACAGGAACAACUCACUGCG | 1640 |
| AD-76187 | A-152190 | csusgeggAfcCfUfUfcacgcccaaL96 | 1547 | A-152191 | VPusUfsgegGfcGfUfgaagGfuCfccagsusg | 1594 | CACUGCGGACCUUCACGCCGCAG | 1641 |
| AD-76188 | A-152192 | csesucucUfgGfGfAfAfacuguccuaL96 | 1548 | A-152193 | VPusGfsgagAfcCfAfGfGfuuccCfaGfagagssusu | 1595 | AACCUCUCUGGGAACCUGUCCCG | 1642 |
| AD-76189 | A-152194 | gscsucucGfcCfcGfCfAfAfaccgcuggaL96 | 1549 | A-152195 | VPusCfscagGfcGfGfuuugCfgGfagacgsuc | 1596 | CUGCUCCCCGAACCGCCUGGC | 1643 |
| AD-76190 | A-152196 | csgsucucGfcCfAfCfAfAfaccgcuggaL96 | 1550 | A-152197 | VPusCfscagGfcGfGfuuugCfgGfagacgsuc | 1597 | GACGUCCUGCACAACCGCCUGGA | 1644 |
| AD-76191 | A-152198 | csaascguUfagAfCfCfacaaccagcaL96 | 1551 | A-152199 | VPusCfscagGfcUfGfugguCfuAfgcguasg | 1598 | CUCACGCUAGACCACCAGCU | 1645 |
| AD-76192 | A-152200 | usgscucUfcCfGfCfaaccgccugaL96 | 1552 | A-152201 | VPusCfsaggCfgGfUfugegGfaAfgagcasgc | 1599 | GCUGCUCCCGCAACCGCCUG | 1646 |
| AD-76193 | A-152202 | ascscucaGfcCfUfCfaggaacaacaL96 | 1553 | A-152203 | VPusGfsuugUfuCfCfugagGfcUfgagusasg | 1600 | CUACCUCAGCCUCCAGAGAACAACU | 1647 |

TABLE 14-continued

Modified Sense and Antisense Strand Sequences of IGFALS dsRNAs

| Duplex Name | Sense Oligo Name | Sense Oligo Sequence | SEQ ID NO | Antisense Oligo Name | Antisense Oligo Sequence | SEQ ID NO | mRNA target sequence | SEQ ID NO |
|---|---|---|---|---|---|---|---|---|
| AD-76194 | A-152204 | csasccuuCfaGfGfGfaccugcacuaL96 | 1554 | A-152205 | VPusAfsgugCfaGfGfuccuUfgAfaggugscsg | 1601 | CGCACCUUCAAGGACCUGCACUU | 1648 |
| AD-76195 | A-152206 | gsgsccucGfuGfGfGfcauugaggaaL96 | 1555 | A-152207 | VPusUfscccuCfaAfUfgcccAfcGfgaggccgsu | 1602 | ACGGCCUCGUGGGCAUUGAGGAG | 1649 |
| AD-76196 | A-152208 | ascccuucAfaGfGfAfccugcacuaL96 | 1556 | A-152209 | VPusAfsaguGfcAfGfguccUfuGfaaggugsc | 1603 | GCACCUUCAAGGACCUGCACUUC | 1650 |
| AD-76197 | A-152210 | gsgsccuuCfuGfGfCfuggacgucuaL96 | 1557 | A-152211 | VPusAfsgacGfucCfCfagccAfgAfaggcccscsg | 1604 | CGGGCCUUCUGGCUGGACGUCUC | 1651 |
| AD-76198 | A-152212 | gsgscauuGfaGfGfAfgcagacguaL96 | 1558 | A-152213 | VPusAfsggcUfcUfGfcucсUfCfAfaugcscsca | 1605 | UGGGCAUUGAGGAGCAGAGCCUG | 1652 |
| AD-76199 | A-152214 | gscsccuuCfaGfAfAfcccuccagaL96 | 1559 | A-152215 | VPusCfsuggAfgAfGfguucUfgGfaaggcsusg | 1606 | CAGCCUUCCAGAACCCUCCCAGC | 1653 |
| AD-76200 | A-152216 | gscsggucAfuGfAfAfcccucuggaL96 | 1560 | A-152217 | VPusCfscagAfgAfGfguucAfuGfaccgcscsa | 1607 | UGGCGGUCAUGAACCUCUCUGGG | 1654 |
| AD-76201 | A-152218 | asgsgcugCfaGfGfAfcgggcucuuaL96 | 1561 | A-152219 | VPusAfsagaGfcCfCfguccUfcCfagccusgsc | 1608 | GCAGGCUGGAGGACGGGCUCUUC | 1655 |
| AD-76202 | A-152220 | csuscuacCfuGfGfAfccgcaaccuaL96 | 1562 | A-152221 | VPusAfsgguUfgCfGfguccAfgGfuagagsusu | 1609 | AACUCUACCUGGACCGCCAACUC | 1656 |
| AD-76203 | A-152222 | gscsggauGfaGfCfAfgccucuuaL96 | 1563 | A-152223 | VPusAfsagaCfgGfcugcUfcAfuccgcsgsu | 1610 | ACGCGAUGAGCAGGCUGAGCGUCUC | 1657 |
| AD-76204 | A-152224 | cscsgucuGfaGfCfAfggcuggagaL96 | 1564 | A-152225 | VPusCfscucCfaGfCfcugcUfcAfgacggsusu | 1611 | AACCGUCUGAGCAGGCUGGAGGA | 1658 |
| AD-76205 | A-152226 | gsgsucauGfaAfCfCfuucugggaaL96 | 1565 | A-152227 | VPusUfsccccAfgAfAfgguuUfcAfugaccsgsc | 1612 | GCGGUCAUGAACCUCUCUGGGAA | 1659 |
| AD-76206 | A-152228 | csusgcagCfuGfGfGfcccaaccgaL96 | 1566 | A-152229 | VPusCfsgguUfgGfGfgcccAfgCfugcagscsu | 1613 | AGCUGCAGCUGGGCCACAACCGC | 1660 |
| AD-76207 | A-152230 | csgsggagCfcuGfGfAfccugacagaL96 | 1567 | A-152231 | VPusCfsuagCfuGfAfgucAfcAfggaagascsg | 1614 | UCCGGCCUGGAGCCUGAGCACG | 1661 |
| AD-76208 | A-152232 | cscsccuGfuGfUfCfugcgacuaL96 | 1568 | A-152233 | VPusCfsuagCfuGfAfgacAfcAfgcgggscsc | 1615 | GGCCGCCUGGACCUGAGCAGG | 1662 |
| AD-76209 | A-152234 | uscsuucuGfcAfGfCfuccaggacaL96 | 1569 | A-152235 | VPusCfsuucCfuGfAfgacuGfcAfgaagascg | 1616 | CGUCUUCUGCAGACCUGAGGAACC | 1663 |
| AD-76210 | A-152236 | csusggcuGfaGfCfGfcagcuuuagaL96 | 1570 | A-152237 | VPusUfscaaAfgCfUfgcgcUfcAfgccagscsu | 1617 | AGCUGGCUGAGCGCAGCUUUGAG | 1664 |
| AD-76211 | A-152238 | csusgaccAfcCfUfcucaaccaaL96 | 1571 | A-152239 | VPusCfsugguUfgAfGfgucAfgGfucgagscsu | 1618 | AGCUCGACCUGACCUCCAACCAG | 1665 |
| AD-76212 | A-152240 | csuscacCfuCfGfCfuggaauagaL96 | 1572 | A-152241 | VPusUfsuauUfcCfAfgccgAfgGfuugagsgsu | 1619 | ACCUCACCUCGGCUGGAAUAGC | 1666 |
| AD-76213 | A-152242 | gscscuagAfgAfAfCfcugugccaL96 | 1573 | A-152243 | VPusCfsuggCfaCfAfgguuCfuCfuaggcscsc | 1620 | GGGCCUAGAGAACCUGCCACC | 1667 |
| AD-76214 | A-152244 | csaagcuuGfaGfGfuFgcucacguaL96 | 1574 | A-152245 | VPusAfscgcgUfgAfGfcaccUfcAfagcugscsc | 1621 | GGCAGCUUGAGGUGCUCACGCUA | 1668 |

TABLE 14-continued

Modified Sense and Antisense Strand Sequences of IGFALS dsRNAs

| Duplex Name | Sense Oligo Name | Sense Oligo Sequence | SEQ ID NO | Antisense Oligo Name | Antisense Oligo Sequence | SEQ ID NO | mRNA target sequence | SEQ ID NO |
|---|---|---|---|---|---|---|---|---|
| AD-76215 | A-152246 | csasggucCfuCfAfGfugucccucagaL96 | 1575 | A-152247 | VPusCfsugaGfgAfCfacugAfgGfaccugsusc | 1622 | GACAGGUCCUCAGUGUCCUCAGG | 1669 |
| AD-76216 | A-152248 | gscsugcgAfuGfGfCfuggaccugua L96 | 1576 | A-152249 | VPusAfscagGfuCfCfagccAfuCfgcagcsgsc | 1623 | GCGCUGCGAUGGCUGGACCUGUC | 1670 |
| AD-76217 | A-152250 | gsgscaagCfuGfGfAfguaccugcuaL96 | 1577 | A-152251 | VPusAfsgcaGfuUfAfcuccAfgcfuugcscsa | 1624 | UGGGCAAGCUGGAGUACCUGCUG | 1671 |

Example 10-IGF-1 Transcripts, siRNA Design, and siRNA Screening

Bioinformatics

A set of siRNAs targeting the human IGF1, ("insulin like growth factor 1", NCBI refseqID: NM_000618; NCBI GeneID: 3479 (SEQ ID NO:13), as well as toxicology-species IGF1 orthologs (cynomolgus monkey: XM_005572039) were designed using custom R and Python scripts. The human NM_000618 REFSEQ mRNA, version 3, has a length 7321 of bases.

The rationale and method for the set of siRNA designs is as follows: the predicted efficacy for every potential 19mer siRNA from position 10 through the end was determined with a linear model derived the direct measure of mRNA knockdown from more than 20,000 distinct siRNA designs targeting a large number of vertebrate genes. Subsets of the IGF1 siRNAs were designed with perfect or near-perfect matches between human and cynomolgus monkey. For each strand of the siRNA, a custom Python script was used in a brute force search to measure the number and positions of mismatches between the siRNA and all potential alignments in the target species transcriptome. Extra weight was given to mismatches in the seed region, defined here as positions 2-9 of the antisense oligonucleotide, as well the cleavage site of the siRNA, defined here as positions 10-11 of the antisense oligonucleotide. The relative weight of the mismatches was 2.8; 1.2:1 for seed mismatches, cleavage site, and other positions up through antisense position 19. Mismatches in the first position were ignored. A specificity score was calculated for each strand by summing the value of each weighted mismatch. Preference was given to siRNAs whose antisense score in human was >=2.2 and predicted efficacy was >=50% knockdown of the transcript.

In Vitro Dual-Glo® Screening

Cell Culture and Transfections

Cos 7 cells (ATCC, Manassas, Va.) were grown to near confluence at 37° C. in an atmosphere of 5% $CO_2$ in DMEM (ATCC) supplemented with 10% FBS, before being released from the plate by trypsinization. Three human IGF-1 Dual-Glo® Luciferase constructs were generated using the psi-CHECK2 vector. Construct one contained sequence based on NM_001111285 (SEQ ID NO:1672), while constructs two and three contained sequence based on NM_000618 (SEQ ID NOs: 1673 and 1674). Dual-luciferase plasmids were co-transfected with siRNA into 5000 cells using Lipofectamine RNAiMax (Invitrogen, Carlsbad Calif. cat #13778-150). For each well of a 384 well plate, 0.1 µl of Lipofectamine was added to 5 ng of plasmid vector and siRNA in 15 µl of Opti-MEM and allowed to complex at room temperature for 15 minutes. The mixture was then added to the cells resuspended in 35 ul of fresh complete media. Cells were incubated for 48 hours before luciferase was measured. Screen was performed at 10 nM and 0.1 nM final duplex concentration.

Dual-Glo® Luciferase Assay 48 hours after the siRNAs were transfected, Firefly (transfection control) and *Renilla* (fused to IGF1 target sequence in 3' UTR) luciferase were measured. First, media was removed from cells. Then Firefly luciferase activity was measured by adding 20 ul of Dual-Glo® Luciferase Reagent mixed with 20 ul of complete media to each well. The mixture was incubated at room temperature for 30 minutes before luminescense (500 nm) was measured on a Spectramax (Molecular Devices) to detect the Firefly luciferase signal. *Renilla* luciferase activity was measured by adding 20 ul of room temperature of Dual-Glo® Stop & Glo® Reagent to each well and the plates were incubated for 20 minutes before luminescence was again measured to determine the *Renilla* luciferase signal. The Dual-Glo® Stop & Glo® Reagent quenched the firefly luciferase signal and sustained luminescence for the *Renilla* luciferase reaction. siRNA activity was determined by normalizing the *Renilla* (IGF1) signal to the Firefly (control) signal within each well. The magnitude of siRNA activity was then assessed relative to cells that were transfected with the same vector but were not treated with siRNA or were treated with a non-targeting siRNA. All transfections were done in quadruplicates.

TABLE 15

Unmodified Sense and Antisense Strand Sequences of IGF-1dsRNAs

| Duplex Name | Sense Oligo Name | Sense Sequence | Position in NM_000618.3 | SEQ ID NO | Antisense Oligo Name | Antisense Sequence | Position in NM_000618.3 | SEQ ID NO |
|---|---|---|---|---|---|---|---|---|
| AD-75740 | A-151647 | AAUGUAACUAAUUGAAUCAUA | 7181-7201 | 1675 | A-151648 | UAUGAUUCAAUUAGUUACAUUUU | 7179-7201 | 1768 |
| AD-75741 | A-151649 | UAAGAAAGUACUUGACUAAAA | 4362-4382 | 1676 | A-151650 | UUUUAGUCAAGUACUUUCUUAAA | 4360-4382 | 1769 |
| AD-75747 | A-151661 | CUUUAUAAUCUUGAAUGAGA | 3765-3785 | 1677 | A-151662 | UCUCAUUCAAGAAUUAUAAAGCA | 3763-3785 | 1770 |
| AD-75748 | A-151663 | AGAUAGAAAUGUAUGUUUGAA | 5223-5243 | 1678 | A-151664 | UUCAAACAACAUUUCUAUCUAG | 5221-5243 | 1771 |
| AD-75749 | A-151665 | UUCCACAAUCCUUAGAAUCUA | 6512-6532 | 1679 | A-151666 | UAGAUUCUAAGGAUUGUGGAAGG | 6510-6532 | 1772 |
| AD-75750 | A-151667 | UAUCAAAACCUUUCAAAUAUA | 6831-6851 | 1680 | A-151668 | UAUAUUUGAAAGGUUUUGAUAUU | 6829-6851 | 1773 |
| AD-75751 | A-151669 | ACAAGUAAAACAUUCCAACAUA | 824-844 | 1681 | A-151670 | UAUGUUGGAAUGUUUACUUGUGU | 822-844 | 1774 |
| AD-75755 | A-151677 | ACAUAGAAAGUUUCUUCAACA | 1410-1430 | 1682 | A-151678 | UGUUGAAGAAACUUUCUAUGUUU | 1408-1430 | 1775 |
| AD-75757 | A-151681 | CAGUCAACAAGUAUAUUUAACA | 3122-3142 | 1683 | A-151682 | UGUUAAAUAUACUUGUUGACUGAA | 3120-3142 | 1776 |
| AD-75759 | A-151685 | CUCAAGCUGUCUACUACAUA | 6769-6789 | 1684 | A-151686 | UAUGUAAGUAGACAGCUUGAGGU | 6767-6789 | 1777 |
| AD-75760 | A-151687 | GAAUUGUGUUCCCUUAUUUGCAA | 1085-1105 | 1685 | A-151688 | UUGCAAAUAAGGAAACAAUUCAU | 1083-1105 | 1778 |
| AD-75761 | A-151689 | AUCUGUCUAGUUGAAAAGCA | 7071-7091 | 1686 | A-151690 | UGCUUUUCAACUAAGACAGAUGU | 7069-7091 | 1779 |
| AD-75765 | A-151697 | AAUUAGCAAUAUAUAUUCCAA | 4632-4652 | 1687 | A-151698 | UUGGAUAUAUAUUGCUAAUUUU | 4630-4652 | 1780 |
| AD-75766 | A-151699 | AAUUGAAUCAAUAUUAUCUACAA | 7190-7210 | 1688 | A-151700 | UUGUAGAUAAUAUUGAUUCAAUUAG | 7188-7210 | 1781 |
| AD-75769 | A-151705 | UUUAUCAAUAAUGUUCUAUAA | 908-928 | 1689 | A-151706 | UUAUAGAACAUUAUUGAUAAAAG | 906-928 | 1782 |
| AD-75772 | A-151711 | GUAAAAGAAACUAUACAUCAA | 3213-3233 | 1690 | A-151712 | UUGAUGUAUAGUUUCUUUUACAU | 3211-3233 | 1783 |
| AD-75774 | A-151715 | CUCUGUGAAUGUGUUUUAUCA | 5173-5193 | 1691 | A-151716 | UGAUAAAACACAUUCACAGAGAG | 5171-5193 | 1784 |
| AD-75776 | A-151719 | AAUGAGGAAUAAUAAGUAAA | 2737-2757 | 1692 | A-151720 | UUUAACUAUUAUUCCUCAUUCU | 2735-2757 | 1785 |
| AD-75778 | A-151723 | GUUCCUUCAAAUGAUGAGUUA | 1438-1458 | 1693 | A-151724 | UAACUCAUCAUUUGAAGGAACUC | 1436-1458 | 1786 |
| AD-75779 | A-151725 | CAGGAUAAAGAUAUCAAUUUA | 5722-5742 | 1694 | A-151726 | UAAAUUGAUAUCUUUAUCCUGUA | 5720-5742 | 1787 |
| AD-75787 | A-151741 | CAUGUCCUCCUCGCAUCUCUA | 297-317 | 1695 | A-151742 | UAGAGAUGCGAGGAGGACAUGGU | 295-317 | 1788 |
| AD-75787 | A-151741 | CAUGUCCUCCUCGCAUCUCUA | 297-317 | 1696 | A-151742 | UAGAGAUGCGAGGAGGACAUGGU | 295-317 | 1789 |
| AD-75788 | A-151743 | UUCCAACAAGCCCACAGGGUAA | 436-456 | 1697 | A-151744 | UUACCCUGUGGGCUUGUUGAAAU | 434-456 | 1790 |

TABLE 15-continued

Unmodified Sense and Antisense Strand Sequences of IGF-1dsRNAs

| Duplex Name | Sense Oligo Name | Sense Sequence | Position in NM_000618.3 | SEQ ID NO | Antisense Oligo Name | Antisense Sequence | Position in NM_000618.3 | SEQ ID NO |
|---|---|---|---|---|---|---|---|---|
| AD-75788 | A-151743 | UUCAACAAGCCCACAGGGUAA | 436-456 | 1698 | A-151744 | UUACCCUGUGGGCUUGUUGAAAU | 434-456 | 1791 |
| AD-75789 | A-151745 | UCCUCGCAUCUCUUCUACCUA | 304-324 | 1699 | A-151746 | UAGGUAGAAGAGAUGCGAGGAGG | 302-324 | 1792 |
| AD-75789 | A-151745 | UCCUCGCAUCUCUUCUACCUA | 304-324 | 1700 | A-151746 | UAGGUAGAAGAGAUGCGAGGAGG | 302-324 | 1793 |
| AD-75790 | A-151747 | GGGGCUUUUAUUUCAACAAGA | 425-445 | 1701 | A-151748 | UCUUGUUGAAAUAAAAGCCCCUG | 423-445 | 1794 |
| AD-75790 | A-151747 | GGGGCUUUUAUUUCAACAAGA | 425-445 | 1702 | A-151748 | UCUUGUUGAAAUAAAAGCCCCUG | 423-445 | 1795 |
| AD-75791 | A-151749 | GAUGCUCUUCAGUUCGUGUGA | 397-417 | 1703 | A-151750 | UCACACGAACUGAAGAGCAUCCA | 395-417 | 1796 |
| AD-75791 | A-151749 | GAUGCUCUUCAGUUCGUGUGA | 397-417 | 1704 | A-151750 | UCACACGAACUGAAGAGCAUCCA | 395-417 | 1797 |
| AD-75792 | A-151751 | UGGAUGCUCUUCAGUUCGUGA | 395-415 | 1705 | A-151752 | UCACGAACUGAAGAGCAUCCACC | 393-415 | 1798 |
| AD-75792 | A-151751 | UGGAUGCUCUUCAGUUCGUGA | 395-415 | 1706 | A-151752 | UCACGAACUGAAGAGCAUCCACC | 393-415 | 1799 |
| AD-75793 | A-151753 | GGUGGAUGCUCUUCAGUUCGA | 393-413 | 1707 | A-151754 | UCGAACUGAAGAGCAUCCACCAG | 391-413 | 1800 |
| AD-75793 | A-151753 | GGUGGAUGCUCUUCAGUUCGA | 393-413 | 1708 | A-151754 | UCGAACUGAAGAGCAUCCACCAG | 391-413 | 1801 |
| AD-75794 | A-151755 | GCUGGAUGGAUGCUCUUCAGUA | 390-410 | 1709 | A-151756 | UACUGAAGAGCAUCCACCAGCUC | 388-410 | 1802 |
| AD-75794 | A-151755 | GCUGGAUGGAUGCUCUUCAGUA | 390-410 | 1710 | A-151756 | UACUGAAGAGCAUCCACCAGCUC | 388-410 | 1803 |
| AD-75795 | A-151757 | CUGGUGGAUGCUCUUCAGUUA | 391-411 | 1711 | A-151758 | UAACUGAAGAGCAUCCACCAGCU | 389-411 | 1804 |
| AD-75795 | A-151757 | CUGGUGGAUGCUCUUCAGUUA | 391-411 | 1712 | A-151758 | UAACUGAAGAGCAUCCACCAGCU | 389-411 | 1805 |
| AD-77120 | A-154752 | CCAAAAUGCACUGAUGUAAAA | 6586-6606 | 1713 | A-154753 | UUUUACAUCAGUGCAUUUUGGGC | 6584-6606 | 1806 |
| AD-77121 | A-154754 | UCCAGUUGCACUAAAUUCCUA | 1009-1029 | 1714 | A-154755 | UAGGAAUUUAGUGCAACUGGAUC | 1007-1029 | 1807 |
| AD-77122 | A-154756 | CAUUCUUCAACUAUCUUUGAA | 6325-6345 | 1715 | A-154757 | UUCAAAGAUAGUUGAAGAAUGAG | 6323-6345 | 1808 |
| AD-77123 | A-154758 | ACAUUCCAACAAUGUCUUUAA | 832-852 | 1716 | A-154759 | UUAAAGACAUUGUUGGAAUGUUU | 830-852 | 1809 |
| AD-77124 | A-154760 | GGCUAGAAUAAAGAGAUGUAA | 4280-4300 | 1717 | A-154761 | UUACAUCUUUUAUUCUAGCCUU | 4278-4300 | 1810 |
| AD-77125 | A-154762 | UUUCAAGAUAUUUGUAAAAGA | 3789-3809 | 1718 | A-154763 | UCUUUUACAAAUAUCUUGAAAUU | 3787-3809 | 1811 |
| AD-77126 | A-154764 | AUAAGCAUAUUUUGAAAAUGA | 7221-7241 | 1719 | A-154765 | UCAUUUUCAAAAUAUGCUUAUUA | 7219-7241 | 1812 |
| AD-77127 | A-154766 | GUUUUCAAUGCUAGUGUUUAA | 5553-5573 | 1720 | A-154767 | UUAAACACUACGAUUGAAAACAA | 5551-5573 | 1813 |

TABLE 15-continued

Unmodified Sense and Antisense Strand Sequences of IGF-1dsRNAs

| Duplex Name | Sense Oligo Name | Sense Sequence | Position in NM_000618.3 | SEQ ID NO | Antisense Oligo Name | Antisense Sequence | Position in NM_000618.3 | SEQ ID NO |
|---|---|---|---|---|---|---|---|---|
| AD-77128 | A-154768 | CAAUGAAAUACACAAGUAAAA | 813-833 | 1721 | A-154769 | UUUUACUUGUGUAUUUCAUUGGG | 811-833 | 1814 |
| AD-77129 | A-154770 | CAAAAGUCCACUGAUGCAAAA | 1764-1784 | 1722 | A-154771 | UUUUGCAUCAGUGGACUUUUGUG | 1762-1784 | 1815 |
| AD-77130 | A-154772 | AACAUAGAAAGUUUCUCUCAAA | 1409-1429 | 1723 | A-154773 | UUUGAAGAAACUUUCUAUGUUUA | 1407-1429 | 1816 |
| AD-77131 | A-154774 | AACCUAAUUAGUAACUUUCCA | 1465-1485 | 1724 | A-154775 | UGGAAAGUUACUAAUUAGGUUGC | 1463-1485 | 1817 |
| AD-77132 | A-154776 | GACUUAUUUCCUUCACUUAAA | 3442-3462 | 1725 | A-154777 | UUUAAGUGAAGGAAAUAAGUCAU | 3440-3462 | 1818 |
| AD-77133 | A-154778 | GGCUCUCAAACUUAGCAAAAA | 4614-4634 | 1726 | A-154779 | UUUUUGCUAAGUUGAGAGCCAA | 4612-4634 | 1819 |
| AD-77134 | A-154780 | ACAAAGAUAAGUGAAAAGAGA | 2312-2332 | 1727 | A-154781 | UCUCUUUUCACUUAUCUUUGUAU | 2310-2332 | 1820 |
| AD-77135 | A-154782 | GUAGUGUACUGUUCACCAAAA | 4525-4545 | 1728 | A-154783 | UUUUGGUGAACAGUACACUACUU | 4523-4545 | 1821 |
| AD-77136 | A-154784 | UCACCAACUCAUAGCAAAGUA | 6663-6683 | 1729 | A-154785 | UACUUUGCUAUGAGUUGGUGAGU | 6661-6683 | 1822 |
| AD-77137 | A-154786 | AAAAUAACUCAUUAUACCAAA | 3577-3597 | 1730 | A-154787 | UUUGGUAUAAUGAGUUAUUUCA | 3575-3597 | 1823 |
| AD-77138 | A-154788 | AAGAAAGAAUCUUUCCAUUCA | 5344-5364 | 1731 | A-154789 | UGAAUGGAAAGAUUCUUUCUCU | 5342-5364 | 1824 |
| AD-77139 | A-154790 | AUUUCAAGAUAUUUGUAAAAA | 3788-3808 | 1732 | A-154791 | UUUUUACAAAUAUCUUGAAAUG | 3786-3808 | 1825 |
| AD-77140 | A-154792 | AGCUGAAACUCUAGAAUUAAA | 5908-5928 | 1733 | A-154793 | UUUAAUUCUAGAGUUUCAGCUUG | 5906-5928 | 1826 |
| AD-77141 | A-154794 | AAAGAUAAAAUCUGAUUUAUGA | 5394-5414 | 1734 | A-154795 | UCAUAAAUCAGAUUUAUCUUUUG | 5392-5414 | 1827 |
| AD-77142 | A-154796 | UAUUAAAUUAAUCUGAUUGA | 7099-7119 | 1735 | A-154797 | UCAAUCAGAAUUAAUUUAAUAAA | 7097-7119 | 1828 |
| AD-77143 | A-154798 | AAGAAUGAGCUUUCAACUCAA | 3825-3845 | 1736 | A-154799 | UUGAGUUGAAAGCUCAUUCUUAC | 3823-3845 | 1829 |
| AD-77144 | A-154800 | GUUUGAUAACAUUUAAAGAA | 780-800 | 1737 | A-154801 | UUCUUUAAAUGUUAUCAAACUU | 778-800 | 1830 |
| AD-77145 | A-154802 | UGUUUUAAACAAUAGAAGUUA | 1402-1422 | 1738 | A-154803 | UAACUUCUAUGUUUAAAACAUA | 1400-1422 | 1831 |
| AD-77146 | A-154804 | UAAAUAACCCAUUCCAUAGCAA | 2110-2130 | 1739 | A-154805 | UUGCUAUGGAAUGGGUUAUUUAUA | 2108-2130 | 1832 |
| AD-77147 | A-154806 | CACAUAGACUCCUUUAAAACUA | 5196-5216 | 1740 | A-154807 | UAGUUUAAAGGAGUCUAUGUGGG | 5194-5216 | 1833 |
| AD-77148 | A-154808 | AAGUCACAAAGUAUCUUCUA | 2568-2588 | 1741 | A-154809 | UAGAAGAUAACUUUGUGACUUUU | 2566-2588 | 1834 |
| AD-77149 | A-154810 | UAAAGAAAGAAUUAAUGAGAA | 5011-5031 | 1742 | A-154811 | UUCUCAUUAAAUUCUUUCUUUAUC | 5009-5031 | 1835 |
| AD-77150 | A-154812 | GAAAUGUAUGUUUGACUUGUA | 5228-5248 | 1743 | A-154813 | UACAAGUCAAACUACAUUUCUA | 5226-5248 | 1836 |
| AD-77151 | A-154814 | UUUAUAAGACCUUCCUGUUAA | 5611-5631 | 1744 | A-154815 | UUAACAGGAAGGUCUUAUAAAAU | 5609-5631 | 1837 |

TABLE 15-continued

Unmodified Sense and Antisense Strand Sequences of IGF-1dsRNAs

| Duplex Name | Sense Oligo Name | Sense Sequence | Position in NM_000618.3 | SEQ ID NO | Antisense Oligo Name | Antisense Sequence | Position in NM_000618.3 | SEQ ID NO |
|---|---|---|---|---|---|---|---|---|
| AD-77152 | A-154816 | CUGUGAAUGUGUUUAUCCAA | 2739-2759 | 1745 | A-154817 | UUGGAUAAACACAUUCCAGAG | 2737-2759 | 1838 |
| AD-77153 | A-154818 | UUAAUUCUGAUUGUAUUUGAA | 7106-7126 | 1746 | A-154819 | UUCAAAUACAAUCAGAAUUAAU | 7104-7126 | 1839 |
| AD-77154 | A-154820 | UGUCAUCUACCUCCAAAA | 1982-2002 | 1747 | A-154821 | UUUUGAGGUAGAUGAUGACAUA | 1980-2002 | 1840 |
| AD-77155 | A-154822 | CGUGAAAGCAAAACAAUAGGA | 1634-1654 | 1748 | A-154823 | UCCUAUUGUUUUGCUUUCACGUA | 1632-1654 | 1841 |
| AD-77156 | A-154824 | AACAACAAUCUAUAGAUAGA | 4438-4458 | 1749 | A-154825 | UCUAUCUAUAGAAUUGUUGUUUU | 4436-4458 | 1842 |
| AD-77157 | A-154826 | UAAAGUAUUAUUUGAACUUUA | 3920-3940 | 1750 | A-154827 | UAAAGUUCAAAUAAUACUUUAAU | 3918-3940 | 1843 |
| AD-77158 | A-154828 | AGAAAGAAUUUAUGAGAAAUA | 5014-5034 | 1751 | A-154829 | UAUUUCUCAUAAAUUCUUCUUU | 5012-5034 | 1844 |
| AD-77159 | A-154830 | AAAUGCACUGAUGUAAAGUAA | 6589-6609 | 1752 | A-154831 | UUACUUUACAUCAGUGCAUUUG | 6587-6609 | 1845 |
| AD-77160 | A-154832 | AUUAAUUCUGAUUUUGAAUUA | 7105-7125 | 1753 | A-154833 | UCAAAUACAAUCAGAAUUAAUU | 7103-7125 | 1846 |
| AD-77161 | A-154834 | CAAUAAUGUCUAUAGAAAAA | 913-933 | 1754 | A-154835 | UUUUUCUAUAGAACAUUAUUGAU | 911-933 | 1847 |
| AD-77162 | A-154836 | GAUUUUCAAUUGAUUUUGAA | 2269-2289 | 1755 | A-154837 | UUCAAAAUCAAUUGAAAAUCAA | 2267-2289 | 1848 |
| AD-77163 | A-154840 | UUGAUUUGAAUUCUGCAUUA | 2279-2299 | 1756 | A-154841 | UAAUGCAGAAUUCAAAAUCAAAU | 2277-2299 | 1849 |
| AD-77164 | A-154842 | AUUUCAUUUGAUUUUGAAUUA | 2272-2292 | 1757 | A-154843 | UAAUUCAAAAUCAAAAUUGAAAAU | 2270-2292 | 1850 |
| AD-77165 | A-154844 | GUGUCUGUGUAUCAUGAAAA | 6798-6818 | 1758 | A-154845 | UUUUUCAUGAUACACAGACACAG | 6796-6818 | 1851 |
| AD-77166 | A-154846 | GGUUUAUGAAUACAAAGAUA | 2300-2320 | 1759 | A-154847 | UAUCUUUGUAUUCUAUAAACCAA | 2298-2320 | 1852 |
| AD-77167 | A-154848 | GCAGAUCAAGAUUUCUCAUA | 2837-2857 | 1760 | A-154849 | UAUGAGAAAUCUUGAUCUGCAG | 2835-2857 | 1853 |
| AD-77168 | A-154850 | AACUAAUUGAAUCAUUAUCUA | 7186-7206 | 1761 | A-154851 | UAGAUAAUGAUUCAAUUAGUUAC | 7184-7206 | 1854 |
| AD-77169 | A-154852 | UGGUUAUGAAUUGUUUCCUA | 1077-1097 | 1762 | A-154853 | UAGGAAACAAUUCAUAAACCACU | 1075-1097 | 1855 |
| AD-77170 | A-154854 | UAGAUAUGGUGCUAUUUUA | 1574-1594 | 1763 | A-154855 | UAAAAUAGCACCAUAUACUAAA | 1572-1594 | 1856 |
| AD-77171 | A-154856 | CUGUUUAAUAAGCAUAUUUA | 7214-7234 | 1764 | A-154857 | UAAAAUAUGCUUAUUAAACAGUA | 7212-7234 | 1857 |
| AD-77172 | A-154858 | AAAUCAAAACCUUUCAAAA | 6828-6848 | 1765 | A-154859 | UUUUGAAAGGUUUUGAUAUUUG | 6826-6848 | 1858 |
| AD-77173 | A-154860 | ACAGAUGUAAAAGAAACUAUA | 3207-3227 | 1766 | A-154861 | UAUAGUUUCUUUUACAUCUGUCC | 3205-3227 | 1859 |
| AD-77174 | A-154862 | AACUUUGAGGCCAAUCAUUA | 1373-1393 | 1767 | A-154863 | UAAAUGAUUGGCCUCAAGUUGC | 1371-1393 | 1860 |

TABLE 16

IGF-1 in vitro 10 nM and 0.1 nM screen

| Duplex Name | 10 nM AVG | 10 nM STD | 0.1 nM AVG | 0.1 nM STD | Position in NM_000618.3 |
|---|---|---|---|---|---|
| AD-75740 | 2.9 | 1.1 | 20.9 | 1.6 | 7179-7201 |
| AD-75741 | 9.2 | 1.5 | 55.6 | 9.3 | 4360-4382 |
| AD-75747 | 50.3 | 6.8 | 67.7 | 8.8 | 3763-3785 |
| AD-75748 | 8.4 | 1.1 | 36 | 10.1 | 5221-5243 |
| AD-75749 | 7.8 | 1.3 | 65.9 | 3 | 6510-6532 |
| AD-75750 | 4.4 | 1.3 | 48 | 9.3 | 6829-6851 |
| AD-75751 | 5.7 | 1.4 | 51.7 | 9.4 | 822-844 |
| AD-75755 | 29.4 | 7.2 | 60.9 | 3.8 | 1408-1430 |
| AD-75757 | 32.4 | 5.7 | 62.3 | 7.9 | 3120-3142 |
| AD-75759 | 9.8 | 4.3 | 86.5 | 11.1 | 6767-6789 |
| AD-75760 | 32.2 | 7.8 | 56.2 | 7.1 | 1083-1105 |
| AD-75761 | 3.5 | 1.3 | 53.3 | 4.3 | 7069-7091 |
| AD-75765 | 7.6 | 1.9 | 56.5 | 8.6 | 4630-4652 |
| AD-75766 | 3.3 | 2.4 | 35.4 | 7.4 | 7188-7210 |
| AD-75769 | 12.4 | 3.1 | 33.6 | 3.9 | 906-928 |
| AD-75772 | 36.1 | 5.2 | 79.9 | 19.3 | 3211-3233 |
| AD-75774 | 14 | 1.2 | 51.8 | 7.8 | 5171-5193 |
| AD-75776 | 41.1 | 11.6 | 84.2 | 10.3 | 2735-2757 |
| AD-75778 | 42.3 | 7.4 | 56.4 | 6.6 | 1436-1458 |
| AD-75779 | 8.7 | 1.6 | 53.7 | 9.1 | 5720-5742 |
| AD-75787 | 59.5 | 5.5 | 96.5 | 6.2 | 295-317 |
| AD-75787 | 57.5 | 12.9 | 99.5 | 10.4 | 295-317 |
| AD-75788 | 38.5 | 5.2 | 82.2 | 9.3 | 434-456 |
| AD-75788 | 28.1 | 2.1 | 88.3 | 4.4 | 434-456 |
| AD-75789 | 58 | 11.5 | 81.6 | 3 | 302-324 |
| AD-75789 | 65.1 | 16.2 | 93.6 | 5.6 | 302-324 |
| AD-75790 | 54.7 | 5.9 | 90.1 | 1.7 | 423-445 |
| AD-75790 | 64.1 | 6.1 | 92.6 | 4.3 | 423-445 |
| AD-75791 | 17.4 | 5 | 78.8 | 3.9 | 395-417 |
| AD-75791 | 19.5 | 2.1 | 87.5 | 7.1 | 395-417 |
| AD-75792 | 12.7 | 1.5 | 63.7 | 6.2 | 393-415 |
| AD-75792 | 13.9 | 2 | 77.8 | 12.9 | 393-415 |
| AD-75793 | 23.6 | 4.1 | 78.5 | 4.7 | 391-413 |
| AD-75793 | 27.8 | 4.1 | 90.9 | 11.6 | 391-413 |
| AD-75794 | 40.6 | 3.1 | 89 | 12.3 | 388-410 |
| AD-75794 | 46.7 | 4.4 | 91.1 | 9.6 | 388-410 |
| AD-75795 | 32.2 | 8.2 | 75.2 | 6.3 | 389-411 |
| AD-75795 | 27.3 | 5.3 | 77.7 | 7.3 | 389-411 |
| AD-77120 | 17.7 | 1.8 | 83.5 | 3.7 | 6584-6606 |
| AD-77121 | 28.3 | 3.4 | 69 | 5.9 | 1007-1029 |
| AD-77122 | 19.3 | 6.4 | 80.4 | 10.5 | 6323-6345 |
| AD-77123 | 21.2 | 4.1 | 46.9 | 8 | 830-852 |
| AD-77124 | 13.9 | 1.5 | 35.3 | 5.8 | 4278-4300 |
| AD-77125 | 44.5 | 10.3 | 52.4 | 6.9 | 3787-3809 |
| AD-77126 | 4.5 | 3 | 23.6 | 3.9 | 7219-7241 |
| AD-77127 | 8.3 | 1.5 | 43.1 | 4.9 | 5551-5573 |
| AD-77128 | 13.6 | 4.1 | 46.6 | 5.3 | 811-833 |
| AD-77129 | 68.5 | 7.6 | 99.9 | 8.2 | 1762-1784 |
| AD-77130 | 32.1 | 5.8 | 41.4 | 3.4 | 1407-1429 |
| AD-77131 | 36 | 8.5 | 53.8 | 7.2 | 1463-1485 |
| AD-77132 | 44.3 | 8.2 | 71.7 | 5.1 | 3440-3462 |
| AD-77133 | 21.4 | 6.4 | 88.9 | 5.8 | 4612-4634 |
| AD-77134 | 37.9 | 2.4 | 82.4 | 8.7 | 2310-2332 |
| AD-77135 | 19.6 | 5 | 91.8 | 17 | 4523-4545 |
| AD-77136 | 32.3 | 8 | 89.5 | 3.5 | 6661-6683 |
| AD-77137 | 36.8 | 3.3 | 67.7 | 7.7 | 3575-3597 |
| AD-77138 | 2.6 | 1.9 | 71.3 | 6.3 | 5342-5364 |
| AD-77139 | 45.6 | 2.5 | 70.4 | 8.2 | 3786-3808 |
| AD-77140 | 17.1 | 3.2 | 65.4 | 6.1 | 5906-5928 |
| AD-77141 | 56.3 | 17.6 | 112.7 | 8.2 | 5392-5414 |
| AD-77142 | 18.1 | 3.7 | 65.7 | 8.4 | 7097-7119 |
| AD-77143 | 45.7 | 10.1 | 93.6 | 11 | 3823-3845 |
| AD-77144 | 5.5 | 2 | 43.5 | 7.6 | 778-800 |
| AD-77145 | 59.6 | 11.1 | 43.8 | 5.1 | 1400-1422 |
| AD-77146 | 27.7 | 5.8 | 64.8 | 7.7 | 2108-2130 |
| AD-77147 | 6.6 | 5.4 | 75 | 10.2 | 5194-5216 |
| AD-77148 | 37.6 | 6.7 | 65.9 | 8 | 2566-2588 |
| AD-77149 | 5.5 | 0.7 | 35.8 | 5.2 | 5009-5031 |
| AD-77150 | 1.1 | 2.3 | 48.2 | 5.1 | 5226-5248 |
| AD-77151 | 9.1 | 2.3 | 69.2 | 5.9 | 5609-5631 |
| AD-77152 | 52.6 | 5.9 | 93.7 | 6.5 | 2737-2759 |
| AD-77153 | 10.4 | 1 | 37.8 | 6.1 | 7104-7126 |
| AD-77154 | 57.5 | 14.5 | 101.7 | 11.5 | 1980-2002 |
| AD-77155 | 63.3 | 8.5 | 53 | 3.9 | 1632-1654 |
| AD-77156 | 14.8 | 3 | 47.9 | 8.9 | 4436-4458 |
| AD-77158 | 1.3 | 1 | 44.3 | 0.9 | 5012-5034 |
| AD-77159 | 20.5 | 4.9 | 92.3 | 17.2 | 6587-6609 |
| AD-77160 | 10.8 | 5.2 | 39.3 | 4.9 | 7103-7125 |
| AD-77161 | 26.1 | 1.8 | 47.3 | 6.8 | 911-933 |
| AD-77162 | 51.6 | 5.4 | 93.6 | 3.1 | 2267-2289 |
| AD-77163 | 41.2 | 4.4 | 70 | 3.1 | 2277-2299 |
| AD-77164 | 58.5 | 5.8 | 95.5 | 10.9 | 2270-2292 |
| AD-77165 | 11.1 | 2 | 61.7 | 7.1 | 6796-6818 |
| AD-77166 | 40.3 | 5.6 | 74.2 | 1.7 | 2298-2320 |
| AD-77167 | 55 | 9.2 | 84.6 | 18 | 2835-2857 |
| AD-77168 | 7.9 | 0.6 | 28.4 | 3.6 | 7184-7206 |
| AD-77169 | 36.1 | 7.5 | 51.6 | 5.6 | 1075-1097 |
| AD-77170 | 44.4 | 8.8 | 66.7 | 3.6 | 1572-1594 |
| AD-77171 | 13.1 | 1.6 | 50.1 | 9.3 | 7212-7234 |
| AD-77172 | 38.8 | 5.4 | 103.7 | 12.7 | 6826-6848 |
| AD-77173 | 42.4 | 2.8 | 79.8 | 15.2 | 3205-3227 |
| AD-77174 | 48.9 | 3.5 | 83.3 | 6.5 | 1371-1393 |
| Mock | 100 | 6.1 | 100 | 5.6 | |

TABLE 17

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-75740 | A-151647 | asasaguaAfcUfAfAfuugaaucaucauaL96 | 1861 | A-151648 | VPusAfsugaUfuCfAfauuaGfuUfacauususu | 1954 | AAAAUGUAACUAAUUGAAUCAUU | 2047 |
| AD-75741 | A-151649 | usasagaaAfguAfCfuugacuaaaaL96 | 1862 | A-151650 | VPusUfsuuaGfuCfAfaguaCfuUfucuuaasa | 1955 | UUUAAGAAAGUACUUGACUAAAA | 2048 |
| AD-75747 | A-151661 | csusuuauAfauUfCfuugaaugagaL96 | 1863 | A-151662 | VPusCfsucaUfuCfAfagaaUfuAfuaaagcsa | 1956 | UGCUUUAUAAAUCUUGAAUGAGG | 2049 |
| AD-75748 | A-151663 | asgsauagAfaAfUfGfuaguuugaaL96 | 1864 | A-151664 | VPusUfscaaAfcAfUfacauUfuCfuaucusasg | 1957 | CUAGAUAGAAAUGUAUGUUUGAC | 2050 |
| AD-75749 | A-151665 | ususccacAfaUfCfCfuuagaaucuaL96 | 1865 | A-151666 | VPusAfsgauUfcUfAfaggaUfuGfuggaasgsg | 1958 | CCUCCACAACCUUAGAAUCUG | 2051 |
| AD-75750 | A-151667 | usasucaaAfaCfCfUfuuccaaauauaL96 | 1866 | A-151668 | VPusAfsuauUfuGfAfaaggUfuUfugauaususu | 1959 | AAUAUCAAAACCUUUCAAAUAUC | 2052 |
| AD-75751 | A-151669 | ascsaaguAfaAfCfAfuuccaacauaL96 | 1867 | A-151670 | VPusAfsuguUfgGfGfAfauguUfuAfcuuguggsu | 1960 | ACACAAGUAAACAUUCCAACACAU | 2053 |
| AD-75755 | A-151677 | ascsauagAfaAfGfAfGfuauuuaacaL96 | 1868 | A-151678 | VPusGfsuugAfaGfAfaacuUfCfuauguususu | 1961 | AAACAUAGAAAGUUUCUUCAACU | 2054 |
| AD-75757 | A-151681 | csasguaAfeAfAfGfAfuauuuuaacaL96 | 1869 | A-151682 | VPusAfsuuaAfaGfAfAfUfacuuGfuUfgacugsasa | 1962 | UUCAGUCAACAAGUAUUUUAACU | 2055 |
| AD-75759 | A-151685 | csuscaagCfuGfUfCfCfuacuuacaaL96 | 1870 | A-151686 | VPusAfsuguAfaGfAfGfUfagacAfgCfuaucsgsu | 1963 | ACCUCAAGCUGUCUACUUACAUC | 2056 |
| AD-75760 | A-151687 | gsasauugUfuUfCfCfuauuuugcaaL96 | 1871 | A-151688 | VPusUfsgcaAfaUfAfaggaAfaCfaauucsasu | 1964 | AUGAAUUGUUUCCUUAUUUGCAC | 2057 |
| AD-75761 | A-151689 | asuscuguCfuUfAfGfuugaaaagcaL96 | 1872 | A-151690 | VPusGfscuuUfuCfAfacuaAfgAfcagaugsu | 1965 | ACAUCUGUCUUAGUUGAAAAGCA | 2058 |
| AD-75765 | A-151697 | asasuuagCfaAfUfAfAfuauucacaaL96 | 1873 | A-151698 | VPusUfsggaUfAfAfUfauauUfgCfuaauususu | 1966 | AAAAUUAGCAAUAAUAUUAUUCCAA | 2059 |
| AD-75766 | A-151699 | ususuaucAfaUfAfAfuguucauuaaL96 | 1874 | A-151700 | VPusUfsguaAfgAfUfauauUfGfuauuasasg | 1967 | CUAAUUGAACAAUAAUCUACAU | 2060 |
| AD-75769 | A-151705 | ususuaucAfaUfAfAfuguucuauaaL96 | 1875 | A-151706 | VPusUfsauaGfaAfCfauuaUfGfauaaasasg | 1968 | CUUUAUCAAUAAUGUUCUAUAG | 2061 |
| AD-75772 | A-151711 | gsusaaaaGfaAfAfCfuauacaucaaL96 | 1876 | A-151712 | VPusUfsgauGfuAfUfaguuUfcUfuuuacsasu | 1969 | AUGUAAAAGAACUAUACAUCAU | 2062 |
| AD-75774 | A-151715 | asasuuagGfaAfAfUfAfauaaguuaaaL96 | 1877 | A-151716 | VPusUfsuaaCfuUfAfuuauUfcCfuucauuscu | 1970 | AGAAUGAGGAAUAAUAAGUUAAA | 2063 |
| AD-75776 | A-151719 | ususuuucCfuCfAfAfUfGfaugaguuaL96 | 1878 | A-151720 | VPusUfsauaAfaAfCfauuuUfcAfcagagsasg | 1971 | CUCUCUGUGAAUGUGUUUAUCC | 2064 |
| AD-75778 | A-151723 | gsusucuuCfaAfAfUfGfaugagauuaL96 | 1879 | A-151724 | VPusUfsguAfaaCfuUfcauuUfgAfaggaacsusc | 1972 | GAGUCCUUCAAAUGAUGAGUUA | 2065 |
| AD-75779 | A-151725 | csasggauAfaAfGfAfAfuaucaauuaL96 | 1880 | A-151726 | VPusAfsAfsacucUfAfUfaucuUfAfuccugsusa | 1973 | UACAGGAUAUAAAGAUAUCAAUUA | 2066 |
| AD-75787 | A-151741 | csasguccCfuCfUfCfUfCfcgcaucucaaL96 | 1881 | A-151742 | VPusAfsgagAfuGfCfgaggAfGfcaugsgsu | 1974 | ACCAUGUCCUCCUCGCAUCUCUU | 2067 |
| AD-75787 | A-151741 | csasguccCfuCfUfCfUfCfcgcaucucaaL96 | 1882 | A-151742 | VPusAfsgagAfuGfCfgaggAfgCfcaugsgsu | 1975 | ACCAUGUCCUCCUCGCAUCUCUU | 2068 |
| AD-75788 | A-151743 | ususucaacAfaGfCfCfCfaggguaaL96 | 1883 | A-151744 | VPusUfsaccCfuGfUfgggCfuUfugaasasu | 1976 | AUUCAACAAGCCCACCAGGUAU | 2069 |

TABLE 17-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-75788 | A-151743 | ususcaacAfaGfCfCfcacagguaaL96 | 1884 | A-151744 | VPusUfsaccCfuGfUfgggcUfuGfuugaasasu | 1977 | AUUUCAACAAGCCCACAGGGUAU | 2070 |
| AD-75789 | A-151745 | uscscucgCfaUfCfUfcuucuaccuaL96 | 1885 | A-151746 | VPusAfsgguAfgAfAfagagaUfgCfgaggagsg | 1978 | CCUCCUCGCAUCUCUUCUACCUG | 2071 |
| AD-75789 | A-151745 | uscscucgCfaUfCfUfcuucuaccuaL96 | 1886 | A-151746 | VPusAfsgguAfgAfAfagagaUfgCfgaggagsg | 1979 | CCUCCUCGCAUCUCUUCUACCUG | 2072 |
| AD-75790 | A-151747 | gsgsggcuUfuUfAfUfuucaacaagaL96 | 1887 | A-151748 | VPusCfsuugUfuGfAfaauaAfaAfgccccsusg | 1980 | CAGGGGCUUUUAUUUCAACAAGC | 2073 |
| AD-75790 | A-151747 | gsgsggcuUfuUfAfUfuucaacaagaL96 | 1888 | A-151748 | VPusCfsuugUfuGfAfaauaAfaAfgccccsusg | 1981 | CAGGGGCUUUUAUUUCAACAAGC | 2074 |
| AD-75791 | A-151749 | gsasugcuCfuUfCfAfguucgugugaL96 | 1889 | A-151750 | VPusCfsacaCfgAfAfcugaAfgAfgcauccsca | 1982 | UGGAUGCUCUUCAGUCGUGUGU | 2075 |
| AD-75791 | A-151749 | gsasugcuCfuUfCfAfguucgugugaL96 | 1890 | A-151750 | VPusCfsacaCfgAfAfcugaAfgAfgcauccsca | 1983 | UGGAUGCUCUUCAGUCGUGUGU | 2076 |
| AD-75792 | A-151751 | usgsgaugCfuCfUfUfcaguucguugaL96 | 1891 | A-151752 | VPusCfsacgAfaCfUfgaagAfgCfauccascsc | 1984 | GGUGGAUGCUCUUCAGUUCGUGU | 2077 |
| AD-75792 | A-151751 | usgsgaugCfuCfUfUfcaguucguugaL96 | 1892 | A-151752 | VPusCfsacgAfaCfUfgaagAfgCfauccascsc | 1985 | GGUGGAUGCUCUUCAGUUCGUGU | 2078 |
| AD-75793 | A-151753 | gsgsuggaUfgCfUfCfuucaguucgaL96 | 1893 | A-151754 | VPusCfsgaaCfuGfAfagagCfaUfccaccsasg | 1986 | CUGGUGGAUGCUCUUCAGUUCGU | 2079 |
| AD-75793 | A-151753 | gsgsuggaUfgCfUfCfuucaguucgaL96 | 1894 | A-151754 | VPusCfsgaaCfuGfAfagagCfaUfccaccsasg | 1987 | CUGGUGGAUGCUCUUCAGUUCGU | 2080 |
| AD-75794 | A-151755 | gscsuggaCfgAfUfUfGfcucuucaguaL96 | 1895 | A-151756 | VPusAfscugAfaGfAfgcaucCfaAfccagcsusc | 1988 | GAGCUGGAUGCUCUUCAGUU | 2081 |
| AD-75794 | A-151755 | gscsuggaCfgAfUfUfGfcucuucaguaL96 | 1896 | A-151756 | VPusAfscugAfaGfAfgcaucCfaAfccagcsusc | 1989 | GAGCUGGAUGCUCUUCAGUU | 2082 |
| AD-75795 | A-151757 | csusggugGfaUfGfCfCfucuucaguucaL96 | 1897 | A-151758 | VPusAfsacuGfaAfGfagcaUfcCfaccagcsu | 1990 | AGCUGGUGGAUGCUCUUCAGUUC | 2083 |
| AD-75795 | A-151757 | csusggugGfaUfGfCfCfucuucaguucaL96 | 1898 | A-151758 | VPusAfsacuGfaAfGfagcaUfcCfaccagcsu | 1991 | AGCUGGUGGAUGCUCUUCAGUUC | 2084 |
| AD-77120 | A-154752 | cscsaaaaUfgCfAfCffugauguaaauccuaL96 | 1899 | A-151753 | VPusUfsuuaCfaUfCfaguugUfAfuuugggsc | 1992 | GCCCAAAAUGCACUGAUGUAAAG | 2085 |
| AD-77121 | A-154754 | uscscaguUfgCfAfCffuaaauuccucaL96 | 1900 | A-154755 | VPusAfsggaAfUfUfUfaguugCfaAfeuggasusc | 1993 | GAUCCAGUUGCACUAAAUUCCUC | 2086 |
| AD-77122 | A-154756 | csasuucuUfcCfAfAfCfuauculugaaL96 | 1901 | A-154757 | VPusCfscaaAfgAfCfAfaguuGfaAfgaaugasg | 1994 | CUCAUUCUUCCAACUACCAUGU | 2087 |
| AD-77123 | A-154758 | ascsauuccUfaAfCfAfugucuuuaaL96 | 1902 | A-154759 | VPusUfsaaaGfaCfAfauguUfgGfaaugusu | 1995 | AAACAUUCCAACAUGUCUUUAG | 2088 |
| AD-77124 | A-154760 | gsgscuuaGfaAfUfAfaagaugauaaL96 | 1903 | A-154761 | VPusUfsacaUfcCfUfUfuauUfCfUfuaagccsu | 1996 | AAGGCUUAGAAUAAAGAUGUAG | 2089 |
| AD-77125 | A-154762 | ususucaaGfaAfUfAfUfUfUfuugauaaagaL96 | 1904 | A-154763 | VPusCfsuuuUfaCfAfaaauaUfCfUfugaaasu | 1997 | AAUUCAAGAAUAUUUUGAAAAGA | 2090 |
| AD-77126 | A-154764 | asusaagcAfuAfUfUfUfUfgaaaaugUfaL96 | 1905 | A-154765 | VPusCfsauuUfuCfAfaaauAfuGfcuuausa | 1998 | UAAUAAGCAUAUUUUGAAAAUGU | 2091 |
| AD-77127 | A-154766 | gsusuucAfaUfGfCfuaguguuuaaL96 | 1906 | A-154767 | VPusUfsaaaCfacCfUfagcaUfgCfaaacsasa | 1999 | UUGUUUUCAUGCUAGUGUUUAA | 2092 |

TABLE 17-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-77128 | A-154768 | csasaugaAfaUfAfCfacaaguaaaL96 | 1907 | A-154769 | VPusUfsuuaCfuUfGfuuaUfuUfcauugsgsg | 2000 | CCCAUGAAAUACACAAGUAAAC | 2093 |
| AD-77129 | A-154770 | csasaaagUfcCfAfCfugaugcaaaaL96 | 1908 | A-154771 | VPusUfsuugCfauUfCfagugGfaCfuuuugsusg | 2001 | CACAAAGUCCACUGAUGCAAAU | 2094 |
| AD-77130 | A-154772 | asascauaGfaAfAfGfuuucucaaaL96 | 1909 | A-154773 | VPusUfsugaAfgAfAfacuuUfCfaugususa | 2002 | UAAACAUAGAAAGUUUCUUCAAC | 2095 |
| AD-77131 | A-154774 | asasccuaAfuUfAfGfuaacuuuccaL96 | 1910 | A-154775 | VPusUfsugaAfgUfUfacuaAfuUfaggusgsc | 2003 | GCAACCUAAUUAGUACUUUCCU | 2096 |
| AD-77132 | A-154776 | gsascuuaUfuUfCfCfuucacuuaaaL96 | 1911 | A-154777 | VPusUfsuaaGfuGfAfaggaAfaUfaagucsasu | 2004 | AUGACUUAUUCCUCACUUAAU | 2097 |
| AD-77133 | A-154778 | gsgscucuCfaAfAfCfuagcaaaaL96 | 1912 | A-154779 | VPusUfsuuuGfCfUfAfaguuUfgAfgagccsasa | 2005 | UUGGCUCUCAAACUAGCAAAAU | 2098 |
| AD-77134 | A-154780 | ascsaaagAfuAfAfGfugaaaagagaL96 | 1913 | A-154781 | VPusCfsucuUfuUfCfacuuAfcUfuuugusasu | 2006 | AUACAAGAUAAGUGAAAAGAGA | 2099 |
| AD-77135 | A-154782 | gsusagugUfaCfUfGfuucaccaaanL96 | 1914 | A-154783 | VPusUfsuugGfuGfAfacagUfaCfacuacsusu | 2007 | AAGUAGUGUACUGUUCCACCAAU | 2100 |
| AD-77136 | A-154784 | uscsaccaAfcUfCfAfuagcaaaguaL96 | 1915 | A-154785 | VPusUfsuggUfAfUfAfaugaGfuUfgaaussca | 2008 | ACUCCAACUACAUAGCAAAGUC | 2101 |
| AD-77137 | A-154786 | asasaauaAfcUfCfAfuauaaccaaL96 | 1916 | A-154787 | VPusAfscuuUfgCfUfAfaugaGfuUfauuuscsa | 2009 | UGAAAAUAACUCAUAUAACCAAU | 2102 |
| AD-77138 | A-154788 | asasgaaaGfaAfUfCfuuccauucaL96 | 1917 | A-154789 | VPusGfsaauGfgAfAfagauUfcUfuucuscsu | 2010 | AGAAGAAAGAAUCUUCCAUUCA | 2103 |
| AD-77139 | A-154790 | asusuucaAfgAfUfAfuucugauugL96 | 1918 | A-154791 | VPusUfsuuuAfcAfAfaucCfuUfgaaausg | 2011 | CAAUUUCAAGAUAUUGUAAAG | 2104 |
| AD-77140 | A-154792 | asgscugaAfaCfUfCfuagaauuaaaL96 | 1919 | A-154793 | VPusUfsuaaUfuCfUfagagUfuUfcagcusug | 2012 | CAAGCUGAAACUCUAGAAUUAAA | 2105 |
| AD-77141 | A-154794 | asasagauAfaAfUfCfugauuuaugL96 | 1920 | A-154795 | VPusCfsauaAfaUfCfagauUfuAfucuuusg | 2013 | CAAAAGAUAAAUCUGAUUUAUGC | 2106 |
| AD-77142 | A-154796 | usasuuuaAfuUfAfAfuucugauugL96 | 1921 | A-154797 | VPusUfsuuuAfcAfGfaauUfaAfuUfuaaasa | 2014 | UUUAUUUAAAUUAAUUCUGAUUGU | 2107 |
| AD-77143 | A-154798 | asasgaauGfaGfCfUfcAfuucaacucaL96 | 1922 | A-154799 | VPusUfsgagUfuGfAfaagcUfcAfuucuusasc | 2015 | GUAAGAUGAGCUUUCAACCAU | 2108 |
| AD-77144 | A-154800 | gsusuugaUfaAfCfAfuaaaagaaL96 | 1923 | A-154801 | VPusUfscuuUfuAfAfaugUfuAfcaacsusu | 2016 | AAGUUUGAUAACAUUAAAAGAU | 2109 |
| AD-77145 | A-154802 | usgsuuuuAfaAfCfAfuccAfauagcaL96 | 1924 | A-154803 | VPusAfscuUfuCfAfugGfUfAfauuasusa | 2017 | UAUGUUUUAAACAUAGAAAGUUU | 2110 |
| AD-77146 | A-154804 | usasaauaAfccCfCfAfuuccauagcaaL96 | 1925 | A-154805 | VPusUfsgcuAfuGfuuAfAfugGfuUfauuasusa | 2018 | UAUAAAUAACCCAUUCAUAGCAU | 2111 |
| AD-77147 | A-154806 | csascauaGfaCfUfCfuuuaaaacuaL96 | 1926 | A-154807 | VPusAfsguuUfuAfAfagagGfuCfuauguugsg | 2019 | CCCACAUAGACUCUUAAAACUA | 2112 |
| AD-77148 | A-154808 | asasagucAfcAfAfGfuuaucuucuL96 | 1927 | A-154809 | VPusAfsgaaGfaUfAfacuuUfgGfacuuusu | 2020 | AAAAGUCACAAGUUAUCUUCUU | 2113 |
| AD-77149 | A-154810 | usasaagaAfaGfAfAfuuaugagaaL96 | 1928 | A-154811 | VPusUfscucAfuAfAfauucUfuUfcuuuasusc | 2021 | GAUAAAGAAAGAAUUAUGAGAA | 2114 |
| AD-77150 | A-154812 | gsasaaugUfaUfGfUfugacuugguL96 | 1929 | A-154813 | VPusAfscaaGfucCfAfaacaCfAfuuucsusa | 2022 | UAGAAAUGUAUGUUGACUUGUU | 2115 |
| AD-77151 | A-154814 | ususuauaAfgAfltcCfuuccuguuaaL96 | 1930 | A-154815 | VPusUfsaacAfgGfAfagguCfUfuauaaasu | 2023 | AUUUUAUAAGACCUUCCUGUUAG | 2116 |

TABLE 17-continued

Modified Sense and Antisense Strand Sequences of IGF-1 dsRNAs

| Duplex Name | Sense Oligo Name | SEQ ID NO | Sense sequence | Antisense Oligo Name | SEQ ID NO | Antisense sequence | SEQ ID NO | mRNA target sequence | SEQ ID NO |
|---|---|---|---|---|---|---|---|---|---|
| AD-77152 | A-154816 | 1931 | csusgugaAfuGfUfGfuuuauccaaL96 | A-154817 | 2024 | VPusUfsggaUfaAfAfacacAfuUfcacagsasg | 2117 | CUCUGUGAAUGUGUUUAUCCAU | 2117 |
| AD-77153 | A-154818 | 1932 | ususaauuCfuGfAfUfuguauuugaaaL96 | A-154819 | 2025 | VPusUfscaaAfuAfCfaaucAfgAfauuaasusu | 2118 | AAUUAAUUCUGAUUGUAUUUGAA | 2118 |
| AD-77154 | A-154820 | 1933 | usgsucaucCfuAfCfCfuaccucaaaaL96 | A-154821 | 2026 | VPusUfsuugAfgGfUfagguAfgAfugacasusa | 2119 | UAUGUCAUCUACCUCCUCAAAG | 2119 |
| AD-77155 | A-154822 | 1934 | csgsugaaAfgCfaAfAfaacauaggaL96 | A-154823 | 2027 | VPusCfscuaUfuGfUfuuugCfuUfuccacgsusa | 2120 | UACGUGAAAGCAAAACAAUAGGG | 2120 |
| AD-77156 | A-154824 | 1935 | asascaacAfaUfUfCfuauagauagaL96 | A-154825 | 2028 | VPusCfsuauCfuAfUfagaaUfgUfuuguususu | 2121 | AAAACAACAAUCUAUAGAUAGA | 2121 |
| AD-77157 | A-154826 | 1936 | usasaaguAfuUfAfUfuugaacuuuaL96 | A-154827 | 2029 | VPusAfsaagUfuCfAfaauaAfuAfcuuuasasu | 2122 | AAUUAAAGUAUUAUUUGAACUUU | 2122 |
| AD-77158 | A-154828 | 1937 | asgsaaagAfaUfUfUfaugagaauaL96 | A-154829 | 2030 | VPusAfsuuuCfuCfAfuaaaUfcCfuuucususu | 2123 | AAAGAAAGAAUUUAUGAGAAAUU | 2123 |
| AD-77159 | A-154830 | 1938 | asasaaugcAfcUfGfAfuguaaguaaL96 | A-154831 | 2031 | VPusUfsacuUfuAfCfaucaGfuGfcauuususg | 2124 | CAAAUGCACUGAUGUAAAGUAG | 2124 |
| AD-77160 | A-154832 | 1939 | asusuaauUfcUfGfAfuuguauuuaL96 | A-154833 | 2032 | VPusCfsaaaUfAfCfAfaucaGfaAfuuaaususu | 2125 | AAAUUAAUUCUGAUUGUAUUUGA | 2125 |
| AD-77161 | A-154834 | 1940 | csaasauaaUfguUfCfUfuauagaaaaL96 | A-154835 | 2033 | VPusUfsuuuCfuaAfUfcaaauUfgAfaaaucsasa | 2126 | AUCAUAAUGUUCUAUAGAAAAG | 2126 |
| AD-77162 | A-154836 | 1941 | gsasuuuCfaAfUfUfugauuuugaaL96 | A-154837 | 2034 | VPusUfscaaAfaUfCfaaauUfgAfaaucsasa | 2127 | UUGAUUUCAAUUUGAUUUUGAA | 2127 |
| AD-77163 | A-154840 | 1942 | ususgauuUfuGfAfAfuucugcauuaL96 | A-154841 | 2035 | VPusAfsaugCfaGfAfauucAfaUfcaaaasu | 2128 | AUUGAUUUGAAUUCUGCAUUU | 2128 |
| AD-77164 | A-154842 | 1943 | ususucaaUfuUfGfAfuuuugaauuaL96 | A-154843 | 2036 | VPusAfsauuCfaAfAfaucaAfaUfugaaasasu | 2129 | AUUUCAAUUUGAUUUUGAAUUC | 2129 |
| AD-77165 | A-154844 | 1944 | gsusgucuGfuGfUfAfucaugaaaaaL96 | A-154845 | 2037 | VPusUfsuuuCfuaUfGfauacAfcAfgacacsasg | 2130 | CUGUGUCUGUGUAUCAUGAAAAU | 2130 |
| AD-77166 | A-154846 | 1945 | gsgsuuuuAfugAfAfAfuacaagauaL96 | A-154847 | 2038 | VPusAfsucuUfuGfUfauucAfuAfaaaccasa | 2131 | UUGGUUUUAUGAAAUACAAAGAUA | 2131 |
| AD-77167 | A-154848 | 1946 | gscsagaucUfaAffGfAfuuuucucaL96 | A-154849 | 2039 | VPusAfsugaGfaAfAfaucuUfgAfucugcsasg | 2132 | CUGCAGAUCAAGAUUUCUCAUU | 2132 |
| AD-77168 | A-154850 | 1947 | asascuaaUfuGfAfAfucauuaucuaL96 | A-154851 | 2040 | VPusAfsgauAfaUfGfauucAfauUfaguasasc | 2133 | GUAACUAAUGAAUCAUUAUCUU | 2133 |
| AD-77169 | A-154852 | 1948 | usgsguuuAfuGfAfAfuugguuccuaL96 | A-154853 | 2041 | VPusAfsggaAfaCfAfauucAfuAfaaccascsu | 2134 | AGUGGUUUAUGAAAUGGUUCCUU | 2134 |
| AD-77170 | A-154854 | 1949 | usasguauAfaUfGfGfcuauuuaL96 | A-154855 | 2042 | VPusAfsaaaUfaGfCfaccaUfuAfuacuasasa | 2135 | UUUAGUAUAAUGGUGCUAUUUG | 2135 |
| AD-77171 | A-154856 | 1950 | csusguuuAfuAfAfAfgcauauuuaL96 | A-154857 | 2043 | VPusAfsaaaUfAfGfCfuuuaUfuAfaacagsusa | 2136 | UACGUUUUAUAAGCAUAUUUG | 2136 |
| AD-77172 | A-154858 | 1951 | asasauauCfaAfAfAfCfcuuucaaaaL96 | A-154859 | 2044 | VPusUfsuugAfaAfGfguuuUfgAfuauuusg | 2137 | CAAAAUCAAAACCUUUCAAAU | 2137 |
| AD-77173 | A-154860 | 1952 | ascsagauGfuAfAfAfagaaacuauaL96 | A-154861 | 2045 | VPusAfsuagUffUfCfuuuuAfcAfucuguscsc | 2138 | GGACAGAUGUAAAAGAAACUAUA | 2138 |
| AD-77174 | A-154862 | 1953 | asascuuuGfaGfGfCfcaaucauuuaL96 | A-154863 | 2046 | VPusAfsaauGfaUfUfggccUfcAfaaguusgsc | 2139 | GCAACUUUGAGGCCAUCAUUUU | 2139 |

Example 11-Further IGF-1 Transcripts, siRNA Design, and siRNA Screening

Bioinformatics:

A set of siRNAs targeting human IGF1 (human insulin like growth factor 1, NCBI refseqID: NM_000618; NCBI GeneID: 3479) were designed using custom R and Python scripts. The human IGF1 REFSEQ mRNA has a length of 7366 bases.

The rationale and method for the set of siRNA designs is as follows: the predicted efficacy for every potential 19mer siRNA from position 10 through the end was determined with a linear model derived the direct measure of mRNA knockdown from more than 20,000 distinct siRNA designs targeting a large number of vertebrate genes. The custom Python script built the set of siRNAs by systematically selecting a siRNA every 11 bases along the target mRNA starting at position 10. At each of the positions, the neighboring siRNA (one position to the 5' end of the mRNA, one position to the 3' end of the mRNA) was swapped into the design set if the predicted efficacy was better than the efficacy at the exact every-11th siRNA. Low complexity siRNAs, i.e., those with Shannon Entropy measures below 1.35 were excluded from the set.

In Vitro Dual-Glo® Screening

Cell Culture and Transfections

Cos 7 cells (ATCC, Manassas, Va.) were grown to near confluence at 37° C. in an atmosphere of 5% $CO_2$ in DMEM (ATCC) supplemented with 10% FBS, before being released from the plate by trypsinization. Three human IGF-1 Dual-Glo® Luciferase constructs were generated using the psi-CHECK2 vector. Construct one contained sequence based on NM_001111285, while constructs two and three contained sequence based on NM_000618 as provided in the prior Example. Dual-luciferase plasmids were co-transfected with siRNA into 5000 cells using Lipofectamine RNAiMax (Invitrogen, Carlsbad Calif. cat #13778-150). For each well of a 384 well plate, 0.1 µl of Lipofectamine was added to 15 ng of plasmid vector and siRNA in 15 µl of Opti-MEM and allowed to complex at room temperature for 15 minutes. The mixture was then added to the cells resuspended in 35 ul of fresh complete media. Cells were incubated for 48 hours before luciferase was measured. Single dose experiments were performed at 10 nM final duplex concentration.

Dual-Glo® Luciferase Assay

Forty-eight hours after the siRNAs were transfected, Firefly (transfection control) and *Renilla* (fused to IGF1 target sequence in 3' UTR) luciferase were measured. First, media was removed from cells. Then Firefly luciferase activity was measured by adding 20 ul of Dual-Glo® Luciferase Reagent mixed with 20 ul of complete media to each well. The mixture was incubated at room temperature for 30 minutes before luminescense (500 nm) was measured on a Spectramax (Molecular Devices) to detect the Firefly luciferase signal. *Renilla* luciferase activity was measured by adding 20 ul of room temperature of Dual-Glo® Stop & Glo® Reagent to each well and the plates were incubated for 20 minutes before luminescence was again measured to determine the *Renilla* luciferase signal. The Dual-Glo® Stop & Glo® Reagent quenched the firefly luciferase signal and sustained luminescence for the *Renilla* luciferase reaction. siRNA activity was determined by normalizing the *Renilla* (IGF1) signal to the Firefly (control) signal within each well. The magnitude of siRNA activity was then assessed relative to cells that were transfected with the same vector but were not treated with siRNA or were treated with a non-targeting siRNA. All transfections were done in quadruplicates.

TABLE 18

Unmodified Sense and Antisense Strand Sequences of IGF-1 dsRNAs

| Duplex Name | Sense Oligo Name | Sense Sequence | Position in NM_000618.3 | SEQ ID NO | Antisense Oligo Name | Antisense Sequence | Position in NM_000618.3 | SEQ ID NO |
|---|---|---|---|---|---|---|---|---|
| AD-74963 | A-150432 | UAGAUAAAUGUGAGGAUUU | 6-24 | 2140 | A-150433 | AAAUCCUCACAUUUAUCUA | 6-24 | 2420 |
| AD-74964 | A-150434 | UUCUCUAAAUCCCUCUUCU | 24-42 | 2141 | A-150435 | AGAAGAGGGAUUUAGAGAA | 24-42 | 2421 |
| AD-74965 | A-150436 | CUGUUUGCUAAAUCUCACU | 41-59 | 2142 | A-150437 | AGUGAGAUUUAGCAAACAG | 41-59 | 2422 |
| AD-74966 | A-150438 | CUCACUGUCACUGCUAAAU | 54-72 | 2143 | A-150439 | AUUUAGCAGUGACAGUGAG | 54-72 | 2423 |
| AD-74967 | A-150440 | UUCAGAGCAGAUAGAGCCU | 72-90 | 2144 | A-150441 | AGGCUCUAUCUGCUCUGAA | 72-90 | 2424 |
| AD-74968 | A-150442 | CAUUGCUCUCAACAUCUCA | 127-145 | 2145 | A-150443 | UGAGAUGUUGAGAGCAAUG | 127-145 | 2425 |
| AD-74969 | A-150444 | ACCAAUUCAUUUUCAGACU | 185-203 | 2146 | A-150445 | AGUCUGAAAAUGAAUUGGU | 185-203 | 2426 |
| AD-74970 | A-150446 | UUUGUACUUCAGAAGCAAU | 203-221 | 2147 | A-150447 | AUUGCUUCUGAAGUACAAA | 203-221 | 2427 |
| AD-74971 | A-150448 | AUGGGAAAAAUCAGCAGUA | 220-238 | 2148 | A-150449 | UACUGCUGAUUUUUCCCAU | 220-238 | 2428 |
| AD-74972 | A-150450 | CAAUUAUUUAAGUGCUGCU | 247-265 | 2149 | A-150451 | AGCAGCACUUAAAUAAUUG | 247-265 | 2429 |
| AD-74973 | A-150452 | UUGAAGGUGAAGAUGCACA | 277-295 | 2150 | A-150453 | UGUGCAUCUUCACCUUCAA | 277-295 | 2430 |
| AD-74974 | A-150454 | UUUUAUUUCAACAAGCCCA | 430-448 | 2151 | A-150455 | UGGGCUUGUUGAAAUAAAA | 430-448 | 2431 |
| AD-74975 | A-150456 | CACAGGGUAUGGCUCCAGA | 447-465 | 2152 | A-150457 | UCUGGAGCCAUACCCUGUG | 447-465 | 2432 |
| AD-74976 | A-150458 | CAGCAGUCGGAGGGCGCCU | 462-480 | 2153 | A-150459 | AGGCGCCCUCCGACUGCUG | 462-480 | 2433 |
| AD-74977 | A-150460 | UUGCGCACCCCUCAAGCCU | 543-561 | 2154 | A-150461 | AGGCUUGAGGGGUGCGCAA | 543-561 | 2434 |
| AD-74978 | A-150462 | UGCAGGAAACAAGAACUAA | 654-672 | 2155 | A-150463 | UUAGUUCUUGUUUCCUGCA | 654-672 | 2435 |

TABLE 18-continued

Unmodified Sense and Antisense Strand Sequences of IGF-1 dsRNAs

| Duplex Name | Sense Oligo Name | Sense Sequence | Position in NM_000618.3 | SEQ ID NO | Antisense Oligo Name | Antisense Sequence | Position in NM_000618.3 | SEQ ID NO |
|---|---|---|---|---|---|---|---|---|
| AD-74979 | A-150464 | CAGGAUGUAGGAAGACCCU | 672-690 | 2156 | A-150465 | AGGGUCUUCCUACAUCCUG | 672-690 | 2436 |
| AD-74980 | A-150466 | UUAAACUUUGGAACACCUA | 750-768 | 2157 | A-150467 | UAGGUGUUCCAAAGUUUAA | 750-768 | 2437 |
| AD-74981 | A-150468 | AAAUAAGUUUGAUAACAUU | 774-792 | 2158 | A-150469 | AAUGUUAUCAAACUUAUUU | 774-792 | 2438 |
| AD-74982 | A-150470 | UUAAAAGAUGGGCGUUUCA | 792-810 | 2159 | A-150471 | UGAAACGCCCAUCUUUUAA | 792-810 | 2439 |
| AD-74983 | A-150472 | AAAUACACAAGUAAACAUU | 818-836 | 2160 | A-150473 | AAUGUUUACUUGUGUAUUU | 818-836 | 2440 |
| AD-74984 | A-150474 | UUCCAACAUUGUCUUUAGA | 835-853 | 2161 | A-150475 | UCUAAAGACAAUGUUGGAA | 835-853 | 2441 |
| AD-74985 | A-150476 | GGAGUGAUUUGCACCUUGA | 852-870 | 2162 | A-150477 | UCAAGGUGCAAAUCACUCC | 852-870 | 2442 |
| AD-74986 | A-150478 | AUUGCUGUUGAUCUUUUAU | 894-912 | 2163 | A-150479 | AUAAAAGAUCAACAGCAAU | 894-912 | 2443 |
| AD-74987 | A-150480 | UCAAUAAUGUUCUAUAGAA | 912-930 | 2164 | A-150481 | UUCUAUAGAACAUUAUUGA | 912-930 | 2444 |
| AD-74988 | A-150482 | AAAGAAAAAAAAAUAUAU | 930-948 | 2165 | A-150483 | AUAUAUUUUUUUUUCUUU | 930-948 | 2445 |
| AD-74989 | A-150484 | AUAUAUAUAUAUAUCUUAA | 947-965 | 2166 | A-150485 | UUAAGAUAUAUAUAUAUAU | 947-965 | 2446 |
| AD-74990 | A-150486 | UUUCCUUAUUUGCACUUCU | 1091-1109 | 2167 | A-150487 | AGAAGUGCAAAUAAGGAAA | 1091-1109 | 2447 |
| AD-74991 | A-150488 | CUUUCUACACAACUCGGGA | 1108-1126 | 2168 | A-150489 | UCCCGAGUUGUGUAGAAAG | 1108-1126 | 2448 |
| AD-74992 | A-150490 | GCUGUUUGUUUUACAGUGU | 1125-1143 | 2169 | A-150491 | ACACUGUAAAACAAACAGC | 1125-1143 | 2449 |
| AD-74993 | A-150492 | UUACAGUGUCUGAUAAUCU | 1135-1153 | 2170 | A-150493 | AGAUUAUCAGACACUGUAA | 1135-1153 | 2450 |
| AD-74994 | A-150494 | CUGAUAAUCUUGUUAGUCU | 1144-1162 | 2171 | A-150495 | AGACUAACAAGAUUAUCAG | 1144-1162 | 2451 |
| AD-74995 | A-150496 | UAUACCCACCACCUCCCUU | 1162-1180 | 2172 | A-150497 | AAGGGAGGUGGUGGGUAUA | 1162-1180 | 2452 |
| AD-74996 | A-150498 | UUGCCGAAUUUGGCCUCCU | 1195-1213 | 2173 | A-150499 | AGGAGGCCAAAUUCGGCAA | 1195-1213 | 2453 |
| AD-74997 | A-150500 | GCCGAAUUUGGCCUCCUCA | 1197-1215 | 2174 | A-150501 | UGAGGAGGCCAAAUUCGGC | 1197-1215 | 2454 |
| AD-74998 | A-150502 | AAAAGCAGCAGCAAGUCGU | 1215-1233 | 2175 | A-150503 | ACGACUUGCUGCUGCUUUU | 1215-1233 | 2455 |
| AD-74999 | A-150504 | GUCAAGAAGCACACCAAUU | 1232-1250 | 2176 | A-150505 | AAUUGGUGUGCUUCUUGAC | 1232-1250 | 2456 |
| AD-75000 | A-150506 | AGUUGGAUGCAUUUUAUUU | 1293-1311 | 2177 | A-150507 | AAAUAAAAUGCAUCCAACU | 1293-1311 | 2457 |
| AD-75001 | A-150508 | UUAGACACAAAGCUUUAUU | 1311-1329 | 2178 | A-150509 | AAUAAAGCUUUGUGUCUAA | 1311-1329 | 2458 |
| AD-75002 | A-150510 | CACAUCAUGCUUACAAAAA | 1334-1352 | 2179 | A-150511 | UUUUUGUAAGCAUGAUGUG | 1334-1352 | 2459 |
| AD-75003 | A-150512 | AAGAAUAAUGCAAAUAGUU | 1352-1370 | 2180 | A-150513 | AACUAUUUGCAUUAUUCUU | 1352-1370 | 2460 |
| AD-75004 | A-150514 | UGCAACUUUGAGGCCAAUA | 1370-1388 | 2181 | A-150515 | UAUUGGCCUCAAAGUUGCA | 1370-1388 | 2461 |
| AD-75005 | A-150516 | CAUUUUUAGGCAUAUGUUU | 1388-1406 | 2182 | A-150517 | AAACAUAUGCCUAAAAAUG | 1388-1406 | 2462 |
| AD-75006 | A-150518 | UUAAACAUAGAAAGUUUCU | 1406-1424 | 2183 | A-150519 | AGAAACUUUCUAUGUUUAA | 1406-1424 | 2463 |
| AD-75007 | A-150520 | CUUCAACUCAAAAGAGUUA | 1423-1441 | 2184 | A-150521 | UAACUCUUUUGAGUUGAAG | 1423-1441 | 2464 |
| AD-75008 | A-150522 | UCCUUCAAAUGAUGAGUUA | 1440-1458 | 2185 | A-150523 | UAACUCAUCAUUUGAAGGA | 1440-1458 | 2465 |
| AD-75009 | A-150524 | UUAGUAACUUCCUCUUUUU | 1472-1490 | 2186 | A-150525 | AAAAGAGGAAGUUACUAA | 1472-1490 | 2466 |
| AD-75010 | A-150526 | UUUUUCCAUAUAGAGCACU | 1494-1512 | 2187 | A-150527 | AGUGCUCUAUAUGGAAAAA | 1494-1512 | 2467 |
| AD-75011 | A-150528 | CUAUGUAAAUUUAGCAUAU | 1511-1529 | 2188 | A-150529 | AUAUGCUAAAUUUACAUAG | 1511-1529 | 2468 |
| AD-75012 | A-150530 | AUCAAUUAUACAGGAUAUA | 1528-1546 | 2189 | A-150531 | UAUAUCCUGUAUAAUUGAU | 1528-1546 | 2469 |
| AD-75013 | A-150532 | UUUAGUAUAAUGGUGCUAU | 1572-1590 | 2190 | A-150533 | AUAGCACCAUUAUACUAAA | 1572-1590 | 2470 |
| AD-75014 | A-150534 | UUGUUAUAUGAAAGAGUCU | 1599-1617 | 2191 | A-150535 | AGACUCUUUCAUAUAACAA | 1599-1617 | 2471 |
| AD-75015 | A-150536 | ACGGUAAUACGUGAAAGCA | 1625-1643 | 2192 | A-150537 | UGCUUUCACGUAUUACCGU | 1625-1643 | 2472 |

TABLE 18-continued

Unmodified Sense and Antisense Strand Sequences of IGF-1 dsRNAs

| Duplex Name | Sense Oligo Name | Sense Sequence | Position in NM_000618.3 | SEQ ID NO | Antisense Oligo Name | Antisense Sequence | Position in NM_000618.3 | SEQ ID NO |
|---|---|---|---|---|---|---|---|---|
| AD-75016 | A-150538 | AAAACAAUAGGGGAAGCCU | 1643-1661 | 2193 | A-150539 | AGGCUUCCCCUAUUGUUUU | 1643-1661 | 2473 |
| AD-75017 | A-150540 | UACUGAAAACACCAUCCAU | 1690-1708 | 2194 | A-150541 | AUGGAUGGUGUUUUCAGUA | 1690-1708 | 2474 |
| AD-75018 | A-150542 | UUGGGAAAGAAGGCAAAGU | 1709-1727 | 2195 | A-150543 | ACUUUGCCUUCUUUCCCAA | 1709-1727 | 2475 |
| AD-75019 | A-150544 | UCAGACACAAAAGUCCACU | 1757-1775 | 2196 | A-150545 | AGUGGACUUUUGUGUCUGA | 1757-1775 | 2476 |
| AD-75020 | A-150546 | CGAGUCCAGAGAGGAAACU | 1793-1811 | 2197 | A-150547 | AGUUUCCUCUCUGGACUCG | 1793-1811 | 2477 |
| AD-75021 | A-150548 | AAACUGUGGAAUGGAAAAA | 1807-1825 | 2198 | A-150549 | UUUUUCCAUUCCACAGUUU | 1807-1825 | 2478 |
| AD-75022 | A-150550 | AGCAGAAGGCUAGGAAUUU | 1825-1843 | 2199 | A-150551 | AAAUUCCUAGCCUUCUGCU | 1825-1843 | 2479 |
| AD-75023 | A-150552 | UUAGCAGUCCUGGUUUCUU | 1843-1861 | 2200 | A-150553 | AAGAAACCAGGACUGCUAA | 1843-1861 | 2480 |
| AD-75024 | A-150554 | CAAAAUGGGGCAAUAUGU | 1966-1984 | 2201 | A-150555 | ACAUAUUGCCCCCAUUUUG | 1966-1984 | 2481 |
| AD-75025 | A-150556 | UUUAAAAGAUAAAGAUUA | 2016-2034 | 2202 | A-150557 | UAAUCUUUAUCUUUUUAAA | 2016-2034 | 2482 |
| AD-75026 | A-150558 | UCAGAUUUUUUUUACCCUA | 2033-2051 | 2203 | A-150559 | UAGGGUAAAAAAAAUCUGA | 2033-2051 | 2483 |
| AD-75027 | A-150560 | UUUUUUACCCUGGGUUGCU | 2040-2058 | 2204 | A-150561 | AGCAACCCAGGGUAAAAAA | 2040-2058 | 2484 |
| AD-75028 | A-150562 | CUGUAAGGGUGCAACAUCA | 2057-2075 | 2205 | A-150563 | UGAUGUUGCACCCUUACAG | 2057-2075 | 2485 |
| AD-75029 | A-150564 | CUGAGAUGCAAGGAAUUCU | 2090-2108 | 2206 | A-150565 | AGAAUUCCUUGCAUCUCAG | 2090-2108 | 2486 |
| AD-75030 | A-150566 | UUGGUGAAUUGAAUGCUCA | 2140-2158 | 2207 | A-150567 | UGAGCAUUCAAUUCACCAA | 2140-2158 | 2487 |
| AD-75031 | A-150568 | UUCUUGUCAGUGAAGCUAU | 2170-2188 | 2208 | A-150569 | AUAGCUUCACUGACAAGAA | 2170-2188 | 2488 |
| AD-75032 | A-150570 | AAUAACUGGCCAACUAGUU | 2192-2210 | 2209 | A-150571 | AACUAGUUGGCCAGUUAUU | 2192-2210 | 2489 |
| AD-75033 | A-150572 | UGUUAAAAGCUAACAGCUA | 2210-2228 | 2210 | A-150573 | UAGCUGUUAGCUUUUAACA | 2210-2228 | 2490 |
| AD-75034 | A-150574 | CAAUCUCUUAAAACACUUU | 2228-2246 | 2211 | A-150575 | AAAGUGUUUUAAGAGAUUG | 2228-2246 | 2491 |
| AD-75035 | A-150576 | AAAAUAUGUGGGAAGCAUU | 2249-2267 | 2212 | A-150577 | AAUGCUUCCCACAUAUUUU | 2249-2267 | 2492 |
| AD-75036 | A-150578 | UUUGAUUUCAAUUUGAUU | 2266-2284 | 2213 | A-150579 | AAUCAAAUUGAAAAUCAAA | 2266-2284 | 2493 |
| AD-75037 | A-150580 | UUGAAUUCUGCAUUUGGUU | 2285-2303 | 2214 | A-150581 | AACCAAAUGCAGAAUUCAA | 2285-2303 | 2494 |
| AD-75038 | A-150582 | UUUAUGAAUACAAAGAUAA | 2303-2321 | 2215 | A-150583 | UUAUCUUUGUAUUCAUAAA | 2303-2321 | 2495 |
| AD-75039 | A-150584 | GUGAAAAGAGAGAAAGGAA | 2322-2340 | 2216 | A-150585 | UUCCUUUCUCUCUUUUCAC | 2322-2340 | 2496 |
| AD-75040 | A-150586 | AAAGAAAAGGAGAAAAAC | 2340-2358 | 2217 | A-150587 | GUUUUUCUCCUUUUUCUUU | 2340-2358 | 2497 |
| AD-75041 | A-150588 | ACAAAGAGAUUUCUACCAA | 2357-2375 | 2218 | A-150589 | UUGGUAGAAAUCUCUUUGU | 2357-2375 | 2498 |
| AD-75042 | A-150590 | UUGUUAGCACUCACUGACU | 2398-2416 | 2219 | A-150591 | AGUCAGUGAGUGCUAACAA | 2398-2416 | 2499 |
| AD-75043 | A-150592 | UACAUAUCUAGUAAAACCU | 2432-2450 | 2220 | A-150593 | AGGUUUUACUAGAUAUGUA | 2432-2450 | 2500 |
| AD-75044 | A-150594 | CUCGUUUAAUACUAUAAAU | 2449-2467 | 2221 | A-150595 | AUUUAUAGUAUUAAACGAG | 2449-2467 | 2501 |
| AD-75045 | A-150596 | UUUAAUACUAUAAAUAAUA | 2453-2471 | 2222 | A-150597 | UAUUAUUUAUAGUAUUAAA | 2453-2471 | 2502 |
| AD-75046 | A-150598 | UAUUCUAUUCAUUUUGAAA | 2470-2488 | 2223 | A-150599 | UUUCAAAAUGAAUAGAAUA | 2470-2488 | 2503 |
| AD-75047 | A-150600 | UUUGAAAAACACAAUGAUU | 2482-2500 | 2224 | A-150601 | AAUCAUUGUGUUUUUCAAA | 2482-2500 | 2504 |
| AD-75048 | A-150602 | AAGGAAAGUGAUCCAAAAU | 2521-2539 | 2225 | A-150603 | AUUUUGGAUCACUUUCCUU | 2521-2539 | 2505 |
| AD-75049 | A-150604 | UUUGAAUAUUAAAUAAU | 2539-2557 | 2226 | A-150605 | AUUAUUUAAUAUUUCAAA | 2539-2557 | 2506 |
| AD-75050 | A-150606 | UUAAAAUAAUAUCUAAUAA | 2548-2566 | 2227 | A-150607 | UUAUUAGAUAUUAUUUUAA | 2548-2566 | 2507 |
| AD-75051 | A-150608 | AAAAGUCACAAAGUUAUCU | 2566-2584 | 2228 | A-150609 | AGAUAACUUUGUGACUUUU | 2566-2584 | 2508 |
| AD-75052 | A-150610 | UUCUUUAACAAACUUUACU | 2584-2602 | 2229 | A-150611 | AGUAAAGUUUGUUAAAGAA | 2584-2602 | 2509 |

TABLE 18-continued

Unmodified Sense and Antisense Strand Sequences of IGF-1 dsRNAs

| Duplex Name | Sense Oligo Name | Sense Sequence | Position in NM_000618.3 | SEQ ID NO | Antisense Oligo Name | Antisense Sequence | Position in NM_000618.3 | SEQ ID NO |
|---|---|---|---|---|---|---|---|---|
| AD-75053 | A-150612 | CUCUUAUUCUUAGCUGUAU | 2601-2619 | 2230 | A-150613 | AUACAGCUAAGAAUAAGAG | 2601-2619 | 2510 |
| AD-75054 | A-150614 | AUAUACAUUUUUUAAAAG | 2618-2636 | 2231 | A-150615 | CUUUUAAAAAAUGUAUAU | 2618-2636 | 2511 |
| AD-75055 | A-150616 | CAUUUUUUAAAAGUUUGU | 2623-2641 | 2232 | A-150617 | ACAAACUUUUAAAAAAUG | 2623-2641 | 2512 |
| AD-75056 | A-150618 | GUUAAAAUAUGCUUGACUA | 2640-2658 | 2233 | A-150619 | UAGUCAAGCAUAUUUUAAC | 2640-2658 | 2513 |
| AD-75057 | A-150620 | AUGCUUGACUAGAGUUUCA | 2648-2666 | 2234 | A-150621 | UGAAACUCUAGUCAAGCAU | 2648-2666 | 2514 |
| AD-75058 | A-150622 | CAGUUGAAAGGCAAAAACU | 2666-2684 | 2235 | A-150623 | AGUUUUGCCUUUCAACUG | 2666-2684 | 2515 |
| AD-75059 | A-150624 | UUCCAUCACAACAAGAAAU | 2684-2702 | 2236 | A-150625 | AUUUCUUGUUGUGAUGGAA | 2684-2702 | 2516 |
| AD-75060 | A-150626 | UUGGUAUCAAGAAAGUCCA | 2771-2789 | 2237 | A-150627 | UGGACUUUCUUGAUACCAA | 2771-2789 | 2517 |
| AD-75061 | A-150628 | GUUAGUGUACUAGUCCAUA | 2793-2811 | 2238 | A-150629 | UAUGGACUAGUACACUAAC | 2793-2811 | 2518 |
| AD-75062 | A-150630 | CAUAGCCUAGAAAAUGAUA | 2811-2829 | 2239 | A-150631 | UAUCAUUUUCUAGGCUAUG | 2811-2829 | 2519 |
| AD-75063 | A-150632 | UCCCUAUCUGCAGAUCAAA | 2828-2846 | 2240 | A-150633 | UUUGAUCUGCAGAUAGGGA | 2828-2846 | 2520 |
| AD-75064 | A-150634 | UUAUCCAGCAUUCAGAUCU | 2869-2887 | 2241 | A-150635 | AGAUCUGAAUGCUGGAUAA | 2869-2887 | 2521 |
| AD-75065 | A-150636 | UUUUUGGUUAAAAGUACCA | 2906-2924 | 2242 | A-150637 | UGGUACUUUUAACCAAAAA | 2906-2924 | 2522 |
| AD-75066 | A-150638 | UACCCAGGCUUGAUUAUUU | 2920-2938 | 2243 | A-150639 | AAAUAAUCAAGCCUGGGUA | 2920-2938 | 2523 |
| AD-75067 | A-150640 | UCAUGCAAAUUCUAUAUUU | 2938-2956 | 2244 | A-150641 | AAAUAUAGAAUUUGCAUGA | 2938-2956 | 2524 |
| AD-75068 | A-150642 | UUACAUUCUUGGAAAGUCU | 2956-2974 | 2245 | A-150643 | AGACUUUCCAAGAAUGUAA | 2956-2974 | 2525 |
| AD-75069 | A-150644 | UCUUGGAAAGUCUAUAUGA | 2962-2980 | 2246 | A-150645 | UCAUAUAGACUUUCCAAGA | 2962-2980 | 2526 |
| AD-75070 | A-150646 | AAAACAAAAAUAACAUCU | 2980-2998 | 2247 | A-150647 | AGAUGUUAUUUUGUUUU | 2980-2998 | 2527 |
| AD-75071 | A-150648 | UUCUCCCACUGGGUCACCU | 3006-3024 | 2248 | A-150649 | AGGUGACCCAGUGGGAGAA | 3006-3024 | 2528 |
| AD-75072 | A-150650 | CAAGGAUCAGAGGCCAGGA | 3025-3043 | 2249 | A-150651 | UCCUGGCCUCUGAUCCUUG | 3025-3043 | 2529 |
| AD-75073 | A-150652 | AAAAAAAAAAAAAGACUA | 3043-3061 | 2250 | A-150653 | UAGUCUUUUUUUUUUUUU | 3043-3061 | 2530 |
| AD-75074 | A-150654 | UCCCUGGAUCUCUGAAUAU | 3060-3078 | 2251 | A-150655 | AUAUUCAGAGAUCCAGGGA | 3060-3078 | 2531 |
| AD-75075 | A-150656 | AUAUGCAAAAGAAGGCCA | 3077-3095 | 2252 | A-150657 | UGGCCUUCUUUUUGCAUAU | 3077-3095 | 2532 |
| AD-75076 | A-150658 | UAGUGGAGCCAGCAAUCCU | 3100-3118 | 2253 | A-150659 | AGGAUUGCUGGCUCCACUA | 3100-3118 | 2533 |
| AD-75077 | A-150660 | UUAACUCUCAGUCCAACAU | 3137-3155 | 2254 | A-150661 | AUGUUGGACUGAGAGUUAA | 3137-3155 | 2534 |
| AD-75078 | A-150662 | UUAUUUGAAUUGAGCACCU | 3155-3173 | 2255 | A-150663 | AGGUGCUCAAUUCAAAUAA | 3155-3173 | 2535 |
| AD-75079 | A-150664 | CAGAUGUAAAAGAAACUAU | 3208-3226 | 2256 | A-150665 | AUAGUUUCUUUUACAUCUG | 3208-3226 | 2536 |
| AD-75080 | A-150666 | AUACAUCAUUUUUGCCCUA | 3225-3243 | 2257 | A-150667 | UAGGGCAAAAAUGAUGUAU | 3225-3243 | 2537 |
| AD-75081 | A-150668 | UUUUGCCCUCUGCCUGUUU | 3234-3252 | 2258 | A-150669 | AAACAGGCAGAGGGCAAAA | 3234-3252 | 2538 |
| AD-75082 | A-150670 | UUCCAGACAUACAGGUUCU | 3252-3270 | 2259 | A-150671 | AGAACCUGUAUGUCUGGAA | 3252-3270 | 2539 |
| AD-75083 | A-150672 | CUGUGGAAUAAGAUACUGA | 3269-3287 | 2260 | A-150673 | UCAGUAUCUUAUUCCACAG | 3269-3287 | 2540 |
| AD-75084 | A-150674 | UAAGAUACUGGACUCCUCU | 3277-3295 | 2261 | A-150675 | AGAGGAGUCCAGUAUCUUA | 3277-3295 | 2541 |
| AD-75085 | A-150676 | CUUCCCAAGAUGGCACUUA | 3294-3312 | 2262 | A-150677 | UAAGUGCCAUCUUGGGAAG | 3294-3312 | 2542 |
| AD-75086 | A-150678 | GUGUACCUUUUAAAAUUAU | 3334-3352 | 2263 | A-150679 | AUAAUUUUAAAAGGUACAC | 3334-3352 | 2543 |
| AD-75087 | A-150680 | UUCCCUCUCAACAAAACUU | 3352-3370 | 2264 | A-150681 | AAGUUUUGUUGAGAGGGAA | 3352-3370 | 2544 |
| AD-75088 | A-150682 | UUUAUAGGCAGUCUUCUGA | 3369-3387 | 2265 | A-150683 | UCAGAAGACUGCCUAUAAA | 3369-3387 | 2545 |
| AD-75089 | A-150684 | UUUUCUGUCAUAGUUAGAU | 3400-3418 | 2266 | A-150685 | AUCUAACUAUGACAGAAAA | 3400-3418 | 2546 |

TABLE 18-continued

Unmodified Sense and Antisense Strand Sequences of IGF-1 dsRNAs

| Duplex Name | Sense Oligo Name | Sense Sequence | Position in NM_000618.3 | SEQ ID NO | Antisense Oligo Name | Antisense Sequence | Position in NM_000618.3 | SEQ ID NO |
|---|---|---|---|---|---|---|---|---|
| AD-75090 | A-150686 | AUGUGAUAAUUCUAAGAGU | 3417-3435 | 2267 | A-150687 | ACUCUUAGAAUUAUCACAU | 3417-3435 | 2547 |
| AD-75091 | A-150688 | UUCCUUCACUUAAUUCUAU | 3449-3467 | 2268 | A-150689 | AUAGAAUUAAGUGAAGGAA | 3449-3467 | 2548 |
| AD-75092 | A-150690 | AUUAUCUUUCUUAACUUUU | 3517-3535 | 2269 | A-150691 | AAAAGUUAAGAAAGAUAAU | 3517-3535 | 2549 |
| AD-75093 | A-150692 | UUCCAACACAUAAUCCUCU | 3535-3553 | 2270 | A-150693 | AGAGGAUUAUGUGUUGGAA | 3535-3553 | 2550 |
| AD-75094 | A-150694 | AAAUAAAUUGAAAAUAACU | 3567-3585 | 2271 | A-150695 | AGUUAUUUUCAAUUUAUUU | 3567-3585 | 2551 |
| AD-75095 | A-150696 | UCAUUAUACCAAUUCACUA | 3585-3603 | 2272 | A-150697 | UAGUGAAUUGGUAUAAUGA | 3585-3603 | 2552 |
| AD-75096 | A-150698 | AUUUUAUUUUUAAUGAAU | 3603-3621 | 2273 | A-150699 | AUUCAUUAAAAAUAAAAU | 3603-3621 | 2553 |
| AD-75097 | A-150700 | UUAAAACUAGAAAACAAAU | 3621-3639 | 2274 | A-150701 | AUUUGUUUUCUAGUUUUAA | 3621-3639 | 2554 |
| AD-75098 | A-150702 | UUGAUUACUAUAUACUACA | 3662-3680 | 2275 | A-150703 | UGUAGUAUAUAGUAAUCAA | 3662-3680 | 2555 |
| AD-75099 | A-150704 | AUGACUCAGAUUUCAUAGA | 3686-3704 | 2276 | A-150705 | UCUAUGAAAUCUGAGUCAU | 3686-3704 | 2556 |
| AD-75100 | A-150706 | AAAGGAGCAACCAAAAUGU | 3704-3722 | 2277 | A-150707 | ACAUUUUGGUUGCUCCUUU | 3704-3722 | 2557 |
| AD-75101 | A-150708 | GUCACAACCCAAAACUUUA | 3721-3739 | 2278 | A-150709 | UAAAGUUUUGGGUUGUGAC | 3721-3739 | 2558 |
| AD-75102 | A-150710 | AAACUUUACAAGCUUUGCU | 3732-3750 | 2279 | A-150711 | AGCAAAGCUUGUAAAGUUU | 3732-3750 | 2559 |
| AD-75103 | A-150712 | UUCAGAAUUAGAUUGCUUU | 3750-3768 | 2280 | A-150713 | AAAGCAAUCUAAUUCUGAA | 3750-3768 | 2560 |
| AD-75104 | A-150714 | UUAUAAUUCUUGAAUGAGA | 3767-3785 | 2281 | A-150715 | UCUCAUUCAAGAAUUAUAA | 3767-3785 | 2561 |
| AD-75105 | A-150716 | UAAUUCUUGAAUGAGGCAA | 3770-3788 | 2282 | A-150717 | UUGCCUCAUUCAAGAAUUA | 3770-3788 | 2562 |
| AD-75106 | A-150718 | AUUUCAAGAUAUUUGUAAA | 3788-3806 | 2283 | A-150719 | UUUACAAAUAUCUUGAAAU | 3788-3806 | 2563 |
| AD-75107 | A-150720 | AAGAACAGUAAACAUUGGU | 3806-3824 | 2284 | A-150721 | ACCAAUGUUUACUGUUCUU | 3806-3824 | 2564 |
| AD-75108 | A-150722 | UUUCAACUCAUAGGCUUAU | 3835-3853 | 2285 | A-150723 | AUAAGCCUAUGAGUUGAAA | 3835-3853 | 2565 |
| AD-75109 | A-150724 | UUGACCAUACUGGAUACUU | 3865-3883 | 2286 | A-150725 | AAGUAUCCAGUAUGGUCAA | 3865-3883 | 2566 |
| AD-75110 | A-150726 | UUUAAGAUGAGGCAGUUCA | 3939-3957 | 2287 | A-150727 | UGAACUGCCUCAUCUUAAA | 3939-3957 | 2567 |
| AD-75111 | A-150728 | CAUCAGAAUCCACUCUUCU | 3982-4000 | 2288 | A-150729 | AGAAGAGUGGAUUCUGAUG | 3982-4000 | 2568 |
| AD-75112 | A-150730 | UAGGGAUAUGAAAAUCUCU | 4000-4018 | 2289 | A-150731 | AGAGAUUUUCAUAUCCCUA | 4000-4018 | 2569 |
| AD-75113 | A-150732 | UUCACCCUAAGGAUCCAAU | 4081-4099 | 2290 | A-150733 | AUUGGAUCCUUAGGGUGAA | 4081-4099 | 2570 |
| AD-75114 | A-150734 | AUGGAAUACUGAAAAGAAA | 4098-4116 | 2291 | A-150735 | UUUCUUUUCAGUAUUCCAU | 4098-4116 | 2571 |
| AD-75115 | A-150736 | GAAUACUGAAAAGAAAUCA | 4101-4119 | 2292 | A-150737 | UGAUUUCUUUUCAGUAUUC | 4101-4119 | 2572 |
| AD-75116 | A-150738 | ACUUCCUUGAAAAUUUUAU | 4119-4137 | 2293 | A-150739 | AUAAAAUUUUCAAGGAAGU | 4119-4137 | 2573 |
| AD-75117 | A-150740 | UUAAAAACAAACAAACAA | 4137-4155 | 2294 | A-150741 | UUGUUUGUUUGUUUUUAA | 4137-4155 | 2574 |
| AD-75118 | A-150742 | AAACAAAAGCCUGUCCAA | 4154-4172 | 2295 | A-150743 | UUGGACAGGCUUUUGUUU | 4154-4172 | 2575 |
| AD-75119 | A-150744 | UUUGUGUAGAUGAAACCAU | 4208-4226 | 2296 | A-150745 | AUGGUUUCAUCUACACAAA | 4208-4226 | 2576 |
| AD-75120 | A-150746 | UUGGGAGAAGGCUUAGAAU | 4271-4289 | 2297 | A-150747 | AUUCUAAGCCUUCUCCCAA | 4271-4289 | 2577 |
| AD-75121 | A-150748 | UAAAGAUGUAGCACAUUU | 4289-4307 | 2298 | A-150749 | AAAUGUGCUACAUCUUUUA | 4289-4307 | 2578 |
| AD-75122 | A-150750 | UUAUUGUUUGGCCAGCUAU | 4319-4337 | 2299 | A-150751 | AUAGCUGGCCAAACAAUAA | 4319-4337 | 2579 |
| AD-75123 | A-150752 | AUGCCAAUGUGGUGCUAUU | 4336-4354 | 2300 | A-150753 | AAUAGCACCACAUUGGCAU | 4336-4354 | 2580 |
| AD-75124 | A-150754 | AAUGUGGUGCUAUUGUUUA | 4341-4359 | 2301 | A-150755 | UAAACAAUAGCACCACAUU | 4341-4359 | 2581 |
| AD-75125 | A-150756 | CUUUAAGAAAGUACUUGAA | 4359-4377 | 2302 | A-150757 | UUCAAGUACUUUCUUAAAG | 4359-4377 | 2582 |
| AD-75126 | A-150758 | CUAAAAAAAAAGAAAAAA | 4377-4395 | 2303 | A-150759 | UUUUUUCUUUUUUUUUAG | 4377-4395 | 2583 |

TABLE 18-continued

Unmodified Sense and Antisense Strand Sequences of IGF-1 dsRNAs

| Duplex Name | Sense Oligo Name | Sense Sequence | Position in NM_000618.3 | SEQ ID NO | Antisense Oligo Name | Antisense Sequence | Position in NM_000618.3 | SEQ ID NO |
|---|---|---|---|---|---|---|---|---|
| AD-75127 | A-150760 | AAGAAAAAAAGAAAGCAU | 4395-4413 | 2304 | A-150761 | AUGCUUUCUUUUUUUCUU | 4395-4413 | 2584 |
| AD-75128 | A-150762 | AUAGACAUAUUUUUUUAAA | 4412-4430 | 2305 | A-150763 | UUUAAAAAAAUAUGUCUAU | 4412-4430 | 2585 |
| AD-75129 | A-150764 | UUAAAGUAUAAAACAACA | 4426-4444 | 2306 | A-150765 | UGUUGUUUUUAUACUUUAA | 4426-4444 | 2586 |
| AD-75130 | A-150766 | CAAUUCUAUAGAUGAUGA | 4443-4461 | 2307 | A-150767 | UCAUCAUCUAUAGAAUUG | 4443-4461 | 2587 |
| AD-75131 | A-150768 | GGCUUAAUAAAAUAGCAUU | 4460-4478 | 2308 | A-150769 | AAUGCUAUUUUAUUAAGCC | 4460-4478 | 2588 |
| AD-75132 | A-150770 | UAAUAAAAUAGCAUUAGGU | 4464-4482 | 2309 | A-150771 | ACCUAAUGCUAUUUUAUUA | 4464-4482 | 2589 |
| AD-75133 | A-150772 | UAUCUAGCCACCACCACCU | 4484-4502 | 2310 | A-150773 | AGGUGGUGGUGGCUAGAUA | 4484-4502 | 2590 |
| AD-75134 | A-150774 | UUUAUCACUCACAAGUAGU | 4511-4529 | 2311 | A-150775 | ACUACUUGUGAGUGAUAAA | 4511-4529 | 2591 |
| AD-75135 | A-150776 | GGCAGGAGUUGGAAAUUUU | 4566-4584 | 2312 | A-150777 | AAAAUUUCCAACUCCUGCC | 4566-4584 | 2592 |
| AD-75136 | A-150778 | UUUAAAGUUAGAAGGCUCA | 4584-4602 | 2313 | A-150779 | UGAGCCUUCUAACUUUAAA | 4584-4602 | 2593 |
| AD-75137 | A-150780 | CCAUUGUUUUGUUGGCUCU | 4601-4619 | 2314 | A-150781 | AGAGCCAACAAAACAAUGG | 4601-4619 | 2594 |
| AD-75138 | A-150782 | UUAGCAAAAUUAGCAAUAU | 4625-4643 | 2315 | A-150783 | AUAUUGCUAAUUUUGCUAA | 4625-4643 | 2595 |
| AD-75139 | A-150784 | AUAUUAUCCAAUCUUCUGA | 4642-4660 | 2316 | A-150785 | UCAGAAGAUUGGAUAAUAU | 4642-4660 | 2596 |
| AD-75140 | A-150786 | UUAUCCAAUCUUCUGAACU | 4645-4663 | 2317 | A-150787 | AGUUCAGAAGAUUGGAUAA | 4645-4663 | 2597 |
| AD-75141 | A-150788 | AAGAGCAUGGAGAAUAAAC | 4669-4687 | 2318 | A-150789 | GUUUAUUCUCCAUGCUCUU | 4669-4687 | 2598 |
| AD-75142 | A-150790 | ACGCGGGAAAAAGAUCUU | 4686-4704 | 2319 | A-150791 | AAGAUCUUUUUCCCGCGU | 4686-4704 | 2599 |
| AD-75143 | A-150792 | GAUCUUAUAGGCAAAUGA | 4699-4717 | 2320 | A-150793 | UCAUUUGCCUAUAAGAUC | 4699-4717 | 2600 |
| AD-75144 | A-150794 | AAGAAUUUAAAAGAUAAGU | 4717-4735 | 2321 | A-150795 | ACUUAUCUUUUAAAUUCUU | 4717-4735 | 2601 |
| AD-75145 | A-150796 | GUAAGUUCCUUAUUGAUUU | 4734-4752 | 2322 | A-150797 | AAAUCAAUAAGGAACUUAC | 4734-4752 | 2602 |
| AD-75146 | A-150798 | UUUUGUGCACUCUGCUCUA | 4751-4769 | 2323 | A-150799 | UAGAGCAGAGUGCACAAAA | 4751-4769 | 2603 |
| AD-75147 | A-150800 | AAACAGAUAUUCAGCAAGU | 4770-4788 | 2324 | A-150801 | ACUUGCUGAAUAUCUGUUU | 4770-4788 | 2604 |
| AD-75148 | A-150802 | UCAGCAAGUGGAGAAAAUA | 4780-4798 | 2325 | A-150803 | UAUUUUCUCCACUUGCUGA | 4780-4798 | 2605 |
| AD-75149 | A-150804 | AAGAACAAAGAGAAAAAAU | 4798-4816 | 2326 | A-150805 | AUUUUUUCUCUUUGUUCUU | 4798-4816 | 2606 |
| AD-75150 | A-150806 | AUACAUAGAUUUACCUGCA | 4815-4833 | 2327 | A-150807 | UGCAGGUAAAUCUAUGUAU | 4815-4833 | 2607 |
| AD-75151 | A-150808 | UUACCUGCAAAAAUAGCU | 4825-4843 | 2328 | A-150809 | AGCUAUUUUUGCAGGUAA | 4825-4843 | 2608 |
| AD-75152 | A-150810 | UUUAUAGAAGACAUUCUCA | 4884-4902 | 2329 | A-150811 | UGAGAAUGUCUUCUAUAAA | 4884-4902 | 2609 |
| AD-75153 | A-150812 | AGACAUCUCAAAGAGCAGU | 4911-4929 | 2330 | A-150813 | ACUGCUCUUUGAGAUGUCU | 4911-4929 | 2610 |
| AD-75154 | A-150814 | UAUGAGAUGGGGUUAUCU | 4987-5005 | 2331 | A-150815 | AGAUAACCCCAUCUCAUA | 4987-5005 | 2611 |
| AD-75155 | A-150816 | CUACUGAUAAAGAAAGAAU | 5004-5022 | 2332 | A-150817 | AUUCUUUCUUUAUCAGUAG | 5004-5022 | 2612 |
| AD-75156 | A-150818 | AAAGAAUUUAUGAGAAAUU | 5016-5034 | 2333 | A-150819 | AAUUUCUCAUAAAUUCUUU | 5016-5034 | 2613 |
| AD-75157 | A-150820 | UAACAAUCUGUGAAGAUUU | 5050-5068 | 2334 | A-150821 | AAAUCUUCACAGAUUGUUA | 5050-5068 | 2614 |
| AD-75158 | A-150822 | UUUUACUUUAUACAGUCUU | 5098-5116 | 2335 | A-150823 | AAGACUGUAUAAAGUAAAA | 5098-5116 | 2615 |
| AD-75159 | A-150824 | UUUAUGAUUUCUUAAUGU | 5115-5133 | 2336 | A-150825 | ACAUUAAGAAAUUCAUAAA | 5115-5133 | 2616 |
| AD-75160 | A-150826 | UUAAUGUUCAAAAUGACUU | 5127-5145 | 2337 | A-150827 | AAGUCAUUUGAACAUUAA | 5127-5145 | 2617 |
| AD-75161 | A-150828 | UUCUUCUUUUUUUAUAUCA | 5153-5171 | 2338 | A-150829 | UGAUAUAAAAAAAGAAGAA | 5153-5171 | 2618 |
| AD-75162 | A-150830 | AGAAUGAGGAAUAAUAAGU | 5171-5189 | 2339 | A-150831 | ACUUAUUAUUCCUCAUUCU | 5171-5189 | 2619 |
| AD-75163 | A-150832 | UUAAACCCACAUAGACUCU | 5189-5207 | 2340 | A-150833 | AGAGUCUAUGUGGGUUUAA | 5189-5207 | 2620 |

TABLE 18-continued

Unmodified Sense and Antisense Strand Sequences of IGF-1 dsRNAs

| Duplex Name | Sense Oligo Name | Sense Sequence | Position in NM_ 000618.3 | SEQ ID NO | Antisense Oligo Name | Antisense Sequence | Position in NM_ 000618.3 | SEQ ID NO |
|---|---|---|---|---|---|---|---|---|
| AD-75164 | A-150834 | CUUUAAAACUAUAGGCUAA | 5206-5224 | 2341 | A-150835 | UUAGCCUAUAGUUUUAAAG | 5206-5224 | 2621 |
| AD-75165 | A-150836 | AGAUAGAAAUGUAUGUUUA | 5223-5241 | 2342 | A-150837 | UAAACAUACAUUUCUAUCU | 5223-5241 | 2622 |
| AD-75166 | A-150838 | UUUGACUUGUUGAAGCUAU | 5238-5256 | 2343 | A-150839 | AUAGCUUCAACAAGUCAAA | 5238-5256 | 2623 |
| AD-75167 | A-150840 | UUUUUAAUCUUAAAAGAUU | 5284-5302 | 2344 | A-150841 | AAUCUUUUAAGAUUAAAAA | 5284-5302 | 2624 |
| AD-75168 | A-150842 | UUGUGCUAAUUUAUUAGAA | 5301-5319 | 2345 | A-150843 | UUCUAAUAAAUUAGCACAA | 5301-5319 | 2625 |
| AD-75169 | A-150844 | UUAUUAGAGCAGAACCUGU | 5311-5329 | 2346 | A-150845 | ACAGGUUCUGCUCUAAUAA | 5311-5329 | 2626 |
| AD-75170 | A-150846 | GUUUGGCUCUCCUCAGAAA | 5328-5346 | 2347 | A-150847 | UUUCUGAGGAGAGCCAAAC | 5328-5346 | 2627 |
| AD-75171 | A-150848 | CAAUAUUUUCAAAAGAUAA | 5383-5401 | 2348 | A-150849 | UUAUCUUUUGAAAAUAUUG | 5383-5401 | 2628 |
| AD-75172 | A-150850 | UCAAAAGAUAAAUCUGAUU | 5391-5409 | 2349 | A-150851 | AAUCAGAUUUAUCUUUUGA | 5391-5409 | 2629 |
| AD-75173 | A-150852 | UUAUGCAAUGGCAUCAUUU | 5409-5427 | 2350 | A-150853 | AAAUGAUGCCAUUGCAUAA | 5409-5427 | 2630 |
| AD-75174 | A-150854 | UGCAAUGGCAUCAUUUAUU | 5412-5430 | 2351 | A-150855 | AAUAAAUGAUGCCAUUGCA | 5412-5430 | 2631 |
| AD-75175 | A-150856 | UUUAAAACAGAAGAAUUGU | 5430-5448 | 2352 | A-150857 | ACAAUUCUUCUGUUUUAAA | 5430-5448 | 2632 |
| AD-75176 | A-150858 | AACAACAAAGGAAAAUGU | 5505-5523 | 2353 | A-150859 | ACAUUUUCCUUUUGUUGUU | 5505-5523 | 2633 |
| AD-75177 | A-150860 | UUAAUCCUGUAGUACAUAU | 5570-5588 | 2354 | A-150861 | AUAUGUACUACAGGAUUAA | 5570-5588 | 2634 |
| AD-75178 | A-150862 | UUUAAUAUUUUAUAAGACA | 5603-5621 | 2355 | A-150863 | UGUCUUAUAAAAUAUUAAA | 5603-5621 | 2635 |
| AD-75179 | A-150864 | CCUUCCUGUUAGGUAUUAA | 5620-5638 | 2356 | A-150865 | UUAAUACCUAACAGGAAGG | 5620-5638 | 2636 |
| AD-75180 | A-150866 | UUAGGUAUUAGAAAGUGAU | 5628-5646 | 2357 | A-150867 | AUCACUUUCUAAUACCUAA | 5628-5646 | 2637 |
| AD-75181 | A-150868 | AUACAUAGAUAUCUUUUUU | 5645-5663 | 2358 | A-150869 | AAAAAAGAUAUCUAUGUAU | 5645-5663 | 2638 |
| AD-75182 | A-150870 | UUUUUGUGUAAUUUCUAUU | 5659-5677 | 2359 | A-150871 | AAUAGAAAUUACACAAAAA | 5659-5677 | 2639 |
| AD-75183 | A-150872 | UUAAAAAAGAGAGAAGACU | 5677-5695 | 2360 | A-150873 | AGUCUUCUCUCUUUUUUAA | 5677-5695 | 2640 |
| AD-75184 | A-150874 | CUGUCAGAAGCUUUAAGUA | 5694-5712 | 2361 | A-150875 | UACUUAAAGCUUCUGACAG | 5694-5712 | 2641 |
| AD-75185 | A-150876 | UAUGGUACAGGAUAAAGAU | 5715-5733 | 2362 | A-150877 | AUCUUUAUCCUGUACCAUA | 5715-5733 | 2642 |
| AD-75186 | A-150878 | UUAAAUAACCAAUUCCUAU | 5740-5758 | 2363 | A-150879 | AUAGGAAUUGGUUAUUUAA | 5740-5758 | 2643 |
| AD-75187 | A-150880 | UUGUUUUUUAAAGAAACCU | 5773-5791 | 2364 | A-150881 | AGGUUUCUUUAAAAAACAA | 5773-5791 | 2644 |
| AD-75188 | A-150882 | CUCUCACAGAUAAGACAGA | 5790-5808 | 2365 | A-150883 | UCUGUCUUAUCUGUGAGAG | 5790-5808 | 2645 |
| AD-75189 | A-150884 | CAGAAUUUUAUAGAGGGCU | 5884-5902 | 2366 | A-150885 | AGCCCUCUAUAAAAUUCUG | 5884-5902 | 2646 |
| AD-75190 | A-150886 | UCUAGAAUUAAAGGAACCU | 5917-5935 | 2367 | A-150887 | AGGUUCCUUUAAUUCUAGA | 5917-5935 | 2647 |
| AD-75191 | A-150888 | CUCACUGAAAACAUAUAUU | 5934-5952 | 2368 | A-150889 | AAUAUAUGUUUUCAGUGAG | 5934-5952 | 2648 |
| AD-75192 | A-150890 | AAACAUAUAUUUCACGUGU | 5942-5960 | 2369 | A-150891 | ACACGUGAAAUAUAUGUUU | 5942-5960 | 2649 |
| AD-75193 | A-150892 | GUUCCCUCUUUUUUUUUUU | 5959-5977 | 2370 | A-150893 | AAAAAAAAAAGAGGGAAC | 5959-5977 | 2650 |
| AD-75194 | A-150894 | UUAAGCGAUUCUCCUGCCU | 6066-6084 | 2371 | A-150895 | AGGCAGGAGAAUCGCUUAA | 6066-6084 | 2651 |
| AD-75195 | A-150896 | CGGCUAAUUUUUGGAUUU | 6129-6147 | 2372 | A-150897 | AAAUCCAAAAAUUAGCCG | 6129-6147 | 2652 |
| AD-75196 | A-150898 | UUUAUAGAGACGGGGUUU | 6147-6165 | 2373 | A-150899 | AAACCCCGUCUCUAUAAA | 6147-6165 | 2653 |
| AD-75197 | A-150900 | UUUACCAUGUUGGCCAGGU | 6164-6182 | 2374 | A-150901 | ACCUGGCCAACAUGGUAAA | 6164-6182 | 2654 |
| AD-75198 | A-150902 | UUGCUGGGAUUACAGGCAU | 6231-6249 | 2375 | A-150903 | AUGCCUGUAAUCCCAGCAA | 6231-6249 | 2655 |
| AD-75199 | A-150904 | UUAAACAUGAUCCUUCUCU | 6303-6321 | 2376 | A-150905 | AGAGAAGGAUCAUGUUUAA | 6303-6321 | 2656 |
| AD-75200 | A-150906 | GGGGUCUUUCAAGGGGAAA | 6346-6364 | 2377 | A-150907 | UUUCCCCUUGAAAGACCCC | 6346-6364 | 2657 |

TABLE 18-continued

Unmodified Sense and Antisense Strand Sequences of IGF-1 dsRNAs

| Duplex Name | Sense Oligo Name | Sense Sequence | Position in NM_000618.3 | SEQ ID NO | Antisense Oligo Name | Antisense Sequence | Position in NM_000618.3 | SEQ ID NO |
|---|---|---|---|---|---|---|---|---|
| AD-75201 | A-150908 | AAAAAUCCAAGCUUUUUUA | 6364-6382 | 2378 | A-150909 | UAAAAAGCUUGGAUUUUU | 6364-6382 | 2658 |
| AD-75202 | A-150910 | AAAGUAAAAAAAAAAAAAG | 6382-6400 | 2379 | A-150911 | CUUUUUUUUUUUUUACUUU | 6382-6400 | 2659 |
| AD-75203 | A-150912 | AGAGAGGACACAAAACCAA | 6399-6417 | 2380 | A-150913 | UUGGUUUUGUGUCCUCUCU | 6399-6417 | 2660 |
| AD-75204 | A-150914 | UUAAGAUGGAGACAGAGUU | 6444-6462 | 2381 | A-150915 | AACUCUGUCUCCAUCUUAA | 6444-6462 | 2661 |
| AD-75205 | A-150916 | UUUCUCCUAAUAACCGGAA | 6461-6479 | 2382 | A-150917 | UUCCGGUUAUUAGGAGAAA | 6461-6479 | 2662 |
| AD-75206 | A-150918 | GCUGAAUUACCUUUCACUU | 6479-6497 | 2383 | A-150919 | AAGUGAAAGGUAAUUCAGC | 6479-6497 | 2663 |
| AD-75207 | A-150920 | UUCAAAAACAUGACCUUCA | 6497-6515 | 2384 | A-150921 | UGAAGGUCAUGUUUUUGAA | 6497-6515 | 2664 |
| AD-75208 | A-150922 | CAAUCCUUAGAAUCUGCCU | 6517-6535 | 2385 | A-150923 | AGGCAGAUUCUAAGGAUUG | 6517-6535 | 2665 |
| AD-75209 | A-150924 | UUUUAUAUUACUGAGGCCU | 6538-6556 | 2386 | A-150925 | AGGCCUCAGUAAUAUAAAA | 6538-6556 | 2666 |
| AD-75210 | A-150926 | AAAAGUAAACAUUACUCAU | 6557-6575 | 2387 | A-150927 | AUGAGUAAUGUUUACUUUU | 6557-6575 | 2667 |
| AD-75211 | A-150928 | UUUAUUUGCCCAAAAUGA | 6576-6594 | 2388 | A-150929 | UCAUUUUGGGCAAAAUAAA | 6576-6594 | 2668 |
| AD-75212 | A-150930 | CACUGAUGUAAAGUAGGAA | 6594-6612 | 2389 | A-150931 | UUCCUACUUUACAUCAGUG | 6594-6612 | 2669 |
| AD-75213 | A-150932 | AAAAUAAAACAGAGCUCU | 6612-6630 | 2390 | A-150933 | AGAGCUCUGUUUUUAUUUU | 6612-6630 | 2670 |
| AD-75214 | A-150934 | CUAAAAUCCCUUUCAAGCA | 6629-6647 | 2391 | A-150935 | UGCUUGAAAGGGAUUUUAG | 6629-6647 | 2671 |
| AD-75215 | A-150936 | UUGACCCCACUCACCAACU | 6653-6671 | 2392 | A-150937 | AGUUGGUGAGUGGGGUCAA | 6653-6671 | 2672 |
| AD-75216 | A-150938 | UUAUCUUGUACCCGCUGCU | 6722-6740 | 2393 | A-150939 | AGCAGCGGGUACAAGAUAA | 6722-6740 | 2673 |
| AD-75217 | A-150940 | CUGAAACCUCAAGCUGUCU | 6762-6780 | 2394 | A-150941 | AGACAGCUUGAGGUUUCAG | 6762-6780 | 2674 |
| AD-75218 | A-150942 | GUAUCAUGAAAAUGUCUAU | 6806-6824 | 2395 | A-150943 | AUAGACAUUUUCAUGAUAC | 6806-6824 | 2675 |
| AD-75219 | A-150944 | UUCAAAAUAUCAAAACCUU | 6824-6842 | 2396 | A-150945 | AAGGUUUUGAUAUUUUGAA | 6824-6842 | 2676 |
| AD-75220 | A-150946 | UUUCAAAUAUCACGCAGCU | 6841-6859 | 2397 | A-150947 | AGCUGCGUGAUAUUUGAAA | 6841-6859 | 2677 |
| AD-75221 | A-150948 | CUUAUAUUCAGUUUACAUA | 6858-6876 | 2398 | A-150949 | UAUGUAAACUGAAUAUAAG | 6858-6876 | 2678 |
| AD-75222 | A-150950 | UUACAUAAAGGCCCCAAAU | 6870-6888 | 2399 | A-150951 | AUUUGGGGCCUUUAUGUAA | 6870-6888 | 2679 |
| AD-75223 | A-150952 | AUACCAUGUCAGAUCUUUU | 6887-6905 | 2400 | A-150953 | AAAAGAUCUGACAUGGUAU | 6887-6905 | 2680 |
| AD-75224 | A-150954 | AAAAGAGUUAAUGAACUAU | 6910-6928 | 2401 | A-150955 | AUAGUUCAUUAACUCUUUU | 6910-6928 | 2681 |
| AD-75225 | A-150956 | AUGAGAAUUGGGAUUACAU | 6927-6945 | 2402 | A-150957 | AUGUAAUCCCAAUUCUCAU | 6927-6945 | 2682 |
| AD-75226 | A-150958 | AUCAUGUAUUUGCCUCAU | 6944-6962 | 2403 | A-150959 | AUGAGGCAAAAUACAUGAU | 6944-6962 | 2683 |
| AD-75227 | A-150960 | UUAUCACACUUAUAGGCCA | 6969-6987 | 2404 | A-150961 | UGGCCUAUAAGUGUGAUAA | 6969-6987 | 2684 |
| AD-75228 | A-150962 | CAAGUGUGAUAAAUAAACU | 6986-7004 | 2405 | A-150963 | AGUUUAUUUAUCACACUUG | 6986-7004 | 2685 |
| AD-75229 | A-150964 | UUACAGACACUGAAUUAAU | 7004-7022 | 2406 | A-150965 | AUUAAUUCAGUGUCUGUAA | 7004-7022 | 2686 |
| AD-75230 | A-150966 | UUUGAAACCAGAAAAUAAU | 7035-7053 | 2407 | A-150967 | AUUAUUUUCUGGUUUCAAA | 7035-7053 | 2687 |
| AD-75231 | A-150968 | AUGACUGGCCAUUCGUUAA | 7052-7070 | 2408 | A-150969 | UUAACGAAUGGCCAGUCAU | 7052-7070 | 2688 |
| AD-75232 | A-150970 | UUAGUUGAAAGCAUAUUU | 7078-7096 | 2409 | A-150971 | AAAUAUGCUUUUCAACUAA | 7078-7096 | 2689 |
| AD-75233 | A-150972 | UUUUUAUAAAUUAAUUCU | 7095-7113 | 2410 | A-150973 | AGAAUUAAUUUAUAAAAA | 7095-7113 | 2690 |
| AD-75234 | A-150974 | CUGAUUGUAUUUGAAAUUA | 7112-7130 | 2411 | A-150975 | UAAUUUCAAAUACAAUCAG | 7112-7130 | 2691 |
| AD-75235 | A-150976 | UUUGAAAUUAUUAUUCAAU | 7121-7139 | 2412 | A-150977 | AUUGAAUAAUAAUUUCAAA | 7121-7139 | 2692 |
| AD-75236 | A-150978 | UUAUGGCAGAGGAAUAUCA | 7144-7162 | 2413 | A-150979 | UGAUAUUCCUCUGCCAUAA | 7144-7162 | 2693 |
| AD-75237 | A-150980 | UCUAAAAAUGUAACUAAUU | 7175-7193 | 2414 | A-150981 | AAUUAGUUACAUUUUUAGA | 7175-7193 | 2694 |

TABLE 18-continued

Unmodified Sense and Antisense Strand Sequences of IGF-1 dsRNAs

| Duplex Name | Sense Oligo Name | Sense Sequence | Position in NM_000618.3 | SEQ ID NO | Antisense Oligo Name | Antisense Sequence | Position in NM_000618.3 | SEQ ID NO |
|---|---|---|---|---|---|---|---|---|
| AD-75238 | A-150982 | UUUACUGUUUAAUAAGCAU | 7210-7228 | 2415 | A-150983 | AUGCUUAUUAAACAGUAAA | 7210-7228 | 2695 |
| AD-75239 | A-150984 | UGUCAUAAUAAAAUGGUAU | 7252-7270 | 2416 | A-150985 | AUACCAUUUUAUUAUGACA | 7252-7270 | 2696 |
| AD-75240 | A-150986 | AUAUCUUUCUUUAGUAAUU | 7269-7287 | 2417 | A-150987 | AAUUACUAAAGAAAGAUAU | 7269-7287 | 2697 |
| AD-75241 | A-150988 | UUAGUAAUUACAUUAAAAU | 7279-7297 | 2418 | A-150989 | AUUUUAAUGUAAUUACUAA | 7279-7297 | 2698 |
| AD-75242 | A-150990 | AUUAGUCAUGUUUGAUUAA | 7296-7314 | 2419 | A-150991 | UUAAUCAAACAUGACUAAU | 7296-7314 | 2699 |

TABLE 19

IGF-1 in vitro 10 nM screen

| Duplex Name | 10 nM AVG | 10 nM STD | Position in NM_000618.3 |
|---|---|---|---|
| AD-74963 | 2.44 | 2.3 | 6-24 |
| AD-74964 | 7.2 | 5.49 | 24-42 |
| AD-74965 | 3.3 | 3.72 | 41-59 |
| AD-74966 | 4.25 | 1.91 | 54-72 |
| AD-74967 | 15.72 | 4.3 | 72-90 |
| AD-74968 | 3.11 | 0.38 | 127-145 |
| AD-74969 | 17.28 | 0.98 | 185-203 |
| AD-74970 | 7.75 | 1.22 | 203-221 |
| AD-74971 | 4.93 | 4 | 220-238 |
| AD-74972 | 21.83 | 3.83 | 247-265 |
| AD-74973 | 14.71 | 5.65 | 277-295 |
| AD-74974 | 38.48 | 1.73 | 430-448 |
| AD-74975 | 8.99 | 1.93 | 447-465 |
| AD-74976 | 22.76 | 2.57 | 462-480 |
| AD-74977 | 34.47 | 2.7 | 543-561 |
| AD-74978 | 10.33 | 10.14 | 654-672 |
| AD-74979 | 4.03 | 0.6 | 672-690 |
| AD-74980 | 22.84 | 18.43 | 750-768 |
| AD-74981 | 10.09 | 7.19 | 774-792 |
| AD-74982 | 5.27 | 0.53 | 792-810 |
| AD-74983 | 7.33 | 3.35 | 818-836 |
| AD-74984 | 25.15 | 1.05 | 835-853 |
| AD-74985 | 9.51 | 1.12 | 852-870 |
| AD-74986 | 13.08 | 1.24 | 894-912 |
| AD-74987 | 15.81 | 0.07 | 912-930 |
| AD-74988 | 74.25 | 9.8 | 930-948 |
| AD-74989 | 53.17 | 16.23 | 947-965 |
| AD-74990 | 34.92 | 1.88 | 1091-1109 |
| AD-74991 | 35.6 | 2.75 | 1108-1126 |
| AD-74992 | 54.21 | 4.47 | 1125-1143 |
| AD-74993 | 51.57 | 3.65 | 1135-1153 |
| AD-74994 | 20.06 | 0.5 | 1144-1162 |
| AD-74995 | 49.73 | 0.85 | 1162-1180 |
| AD-74996 | 54.67 | 2.95 | 1195-1213 |
| AD-74997 | 24.76 | 9.85 | 1197-1215 |
| AD-74998 | 116.31 | 7.45 | 1215-1233 |
| AD-74999 | 37.97 | 1.63 | 1232-1250 |
| AD-75000 | 17.29 | 1.27 | 1293-1311 |
| AD-75001 | 44.75 | 3.5 | 1311-1329 |
| AD-75002 | 33.61 | 1.4 | 1334-1352 |
| AD-75003 | 50.72 | 3.07 | 1352-1370 |
| AD-75004 | 49.47 | 3.37 | 1370-1388 |
| AD-75005 | 33.73 | 0.68 | 1388-1406 |
| AD-75006 | 62.64 | 3.34 | 1406-1424 |
| AD-75007 | 36.36 | 0.24 | 1423-1441 |
| AD-75008 | 37.81 | 2.85 | 1440-1458 |
| AD-75009 | 19.35 | 1.31 | 1472-1490 |
| AD-75010 | 71.78 | 3.37 | 1494-1512 |
| AD-75011 | 25.82 | 2.55 | 1511-1529 |
| AD-75012 | 55.66 | 5.16 | 1528-1546 |
| AD-75013 | 83.97 | 4.37 | 1572-1590 |

TABLE 19-continued

IGF-1 in vitro 10 nM screen

| Duplex Name | 10 nM AVG | 10 nM STD | Position in NM_000618.3 |
|---|---|---|---|
| AD-75014 | 29.26 | 11.24 | 1599-1617 |
| AD-75015 | 40.19 | 0.14 | 1625-1643 |
| AD-75016 | 38.98 | 4.61 | 1643-1661 |
| AD-75017 | 32.96 | 4.54 | 1690-1708 |
| AD-75018 | 19.3 | 1.74 | 1709-1727 |
| AD-75019 | 71.36 | 5.08 | 1757-1775 |
| AD-75020 | 20.46 | 1.94 | 1793-1811 |
| AD-75021 | 33.72 | 1.42 | 1807-1825 |
| AD-75022 | 84.23 | 3.34 | 1825-1843 |
| AD-75023 | 24.26 | 1.03 | 1843-1861 |
| AD-75024 | 40.83 | 2.06 | 1966-1984 |
| AD-75025 | 48.65 | 1.28 | 2016-2034 |
| AD-75026 | 70.35 | 5.83 | 2033-2051 |
| AD-75027 | 94.74 | 14.09 | 2040-2058 |
| AD-75028 | 29.93 | 7.99 | 2057-2075 |
| AD-75029 | 31.95 | 1.57 | 2090-2108 |
| AD-75030 | 64.72 | 8.6 | 2140-2158 |
| AD-75031 | 44.8 | 3.93 | 2170-2188 |
| AD-75032 | 32.33 | 2.6 | 2192-2210 |
| AD-75033 | 26.13 | 0.64 | 2210-2228 |
| AD-75034 | 43.7 | 7.02 | 2228-2246 |
| AD-75035 | 70.89 | 7.82 | 2249-2267 |
| AD-75036 | 106.4 | 4.66 | 2266-2284 |
| AD-75037 | 47.27 | 4.85 | 2285-2303 |
| AD-75038 | 48.86 | 4.15 | 2303-2321 |
| AD-75039 | 40.63 | 4.83 | 2322-2340 |
| AD-75040 | 107.1 | 7.22 | 2340-2358 |
| AD-75041 | 35.81 | 5.21 | 2357-2375 |
| AD-75042 | 52.59 | 6.79 | 2398-2416 |
| AD-75043 | 55.9 | 9.3 | 2432-2450 |
| AD-75044 | 46.66 | 11.14 | 2449-2467 |
| AD-75045 | 82.13 | 13.7 | 2453-2471 |
| AD-75046 | 73.55 | 5.15 | 2470-2488 |
| AD-75047 | 71.67 | 15.96 | 2482-2500 |
| AD-75048 | 38.18 | 30.65 | 2521-2539 |
| AD-75049 | 92.97 | 13.14 | 2539-2557 |
| AD-75050 | 86 | 15.13 | 2548-2566 |
| AD-75051 | 59.23 | 8.69 | 2566-2584 |
| AD-75052 | 104.39 | 19.17 | 2584-2602 |
| AD-75053 | 58.66 | 10.73 | 2601-2619 |
| AD-75054 | 89.3 | 16.07 | 2618-2636 |
| AD-75055 | 64.45 | 10.53 | 2623-2641 |
| AD-75056 | 95.7 | 23.97 | 2640-2658 |
| AD-75057 | 38.59 | 5.32 | 2648-2666 |
| AD-75058 | 35.56 | 5.16 | 2666-2684 |
| AD-75059 | 62.95 | 9.3 | 2684-2702 |
| AD-75060 | 50.41 | 11.52 | 2771-2789 |
| AD-75061 | 34.92 | 9.92 | 2793-2811 |
| AD-75062 | 52.01 | 10.49 | 2811-2829 |
| AD-75063 | 49.98 | 9.93 | 2828-2846 |
| AD-75064 | 113.1 | 26.07 | 2869-2887 |

TABLE 19-continued

IGF-1 in vitro 10 nM screen

| Duplex Name | 10 nM AVG | 10 nM STD | Position in NM_000618.3 |
|---|---|---|---|
| AD-75065 | 73.65 | 7.55 | 2906-2924 |
| AD-75066 | 43.56 | 5.6 | 2920-2938 |
| AD-75067 | 56.32 | 9.44 | 2938-2956 |
| AD-75068 | 57.61 | 8.64 | 2956-2974 |
| AD-75069 | 34.69 | 12.05 | 2962-2980 |
| AD-75070 | 89.29 | 14.15 | 2980-2998 |
| AD-75071 | 64.02 | 16.69 | 3006-3024 |
| AD-75072 | 125.6 | 49.27 | 3025-3043 |
| AD-75073 | 111.64 | 19.51 | 3043-3061 |
| AD-75074 | 75.61 | 13.18 | 3060-3078 |
| AD-75075 | 111.51 | 16.74 | 3077-3095 |
| AD-75076 | 69.43 | 9.4 | 3100-3118 |
| AD-75077 | 44.04 | 5 | 3137-3155 |
| AD-75078 | 57.27 | 10.2 | 3155-3173 |
| AD-75079 | 28.28 | 5.64 | 3208-3226 |
| AD-75080 | 59.53 | 7.5 | 3225-3243 |
| AD-75081 | 61.41 | 5.87 | 3234-3252 |
| AD-75082 | 54.31 | 7.14 | 3252-3270 |
| AD-75083 | 34.99 | 5.51 | 3269-3287 |
| AD-75084 | 46.86 | 9.9 | 3277-3295 |
| AD-75085 | 56.82 | 7.96 | 3294-3312 |
| AD-75086 | 58.83 | 11.06 | 3334-3352 |
| AD-75087 | 55.26 | 2.93 | 3352-3370 |
| AD-75088 | 34.12 | 16.28 | 3369-3387 |
| AD-75089 | 63.74 | 11.09 | 3400-3418 |
| AD-75090 | 36.81 | 7.73 | 3417-3435 |
| AD-75091 | 31.56 | 5.56 | 3449-3467 |
| AD-75092 | 61.39 | 11.47 | 3517-3535 |
| AD-75093 | 83.2 | 19.37 | 3535-3553 |
| AD-75094 | 80.16 | 13.64 | 3567-3585 |
| AD-75095 | 38.33 | 8.26 | 3585-3603 |
| AD-75096 | 103.57 | 22.84 | 3603-3621 |
| AD-75097 | 69.98 | 7.03 | 3621-3639 |
| AD-75098 | 51.57 | 14.6 | 3662-3680 |
| AD-75099 | 31.97 | 13.18 | 3686-3704 |
| AD-75100 | 94.94 | 9.26 | 3704-3722 |
| AD-75101 | 36.43 | 11.54 | 3721-3739 |
| AD-75102 | 70.66 | 7.75 | 3732-3750 |
| AD-75103 | 57.38 | 5.65 | 3750-3768 |
| AD-75104 | 77.58 | 15.39 | 3767-3785 |
| AD-75105 | 70.13 | 8.3 | 3770-3788 |
| AD-75106 | 50.24 | 6.25 | 3788-3806 |
| AD-75107 | 34.8 | 6.73 | 3806-3824 |
| AD-75108 | 58.82 | 3.73 | 3835-3853 |
| AD-75109 | 65.08 | 10.73 | 3865-3883 |
| AD-75110 | 31.63 | 14.97 | 3939-3957 |
| AD-75111 | 5.82 | 0.91 | 3982-4000 |
| AD-75112 | 11.18 | 0.76 | 4000-4018 |
| AD-75113 | 38.66 | 8.55 | 4081-4099 |
| AD-75114 | 14.58 | 5.96 | 4098-4116 |
| AD-75115 | 12.98 | 2.49 | 4101-4119 |
| AD-75116 | 35.3 | 6.1 | 4119-4137 |
| AD-75117 | 57.1 | 9.56 | 4137-4155 |
| AD-75118 | 23.23 | 4.43 | 4154-4172 |
| AD-75119 | 54.12 | 7.09 | 4208-4226 |
| AD-75120 | 15.15 | 2.22 | 4271-4289 |
| AD-75121 | 19.41 | 4.81 | 4289-4307 |
| AD-75122 | 33.51 | 8.79 | 4319-4337 |
| AD-75123 | 10.61 | 1.98 | 4336-4354 |
| AD-75124 | 22.01 | 6.31 | 4341-4359 |
| AD-75125 | 10.88 | 0.88 | 4359-4377 |
| AD-75126 | 84.91 | 10.8 | 4377-4395 |
| AD-75127 | 71.33 | 14.6 | 4395-4413 |
| AD-75128 | 78.44 | 5.21 | 4412-4430 |
| AD-75129 | 76.77 | 25.96 | 4426-4444 |
| AD-75130 | 15.56 | 6.25 | 4443-4461 |
| AD-75131 | 13.16 | 4.18 | 4460-4478 |
| AD-75132 | 86.74 | 17.91 | 4464-4482 |
| AD-75133 | 36.15 | 4.26 | 4484-4502 |
| AD-75134 | 51.96 | 9.57 | 4511-4529 |
| AD-75135 | 19.14 | 4.52 | 4566-4584 |
| AD-75136 | 43.64 | 6.37 | 4584-4602 |
| AD-75137 | 3.8 | 0.43 | 4601-4619 |
| AD-75138 | 40.31 | 6.39 | 4625-4643 |
| AD-75139 | 20.1 | 4.15 | 4642-4660 |
| AD-75140 | 53.32 | 1.96 | 4645-4663 |
| AD-75141 | 51.87 | 3.72 | 4669-4687 |
| AD-75142 | 32.17 | 4.32 | 4686-4704 |
| AD-75143 | 17.5 | 6.52 | 4699-4717 |
| AD-75144 | 94.26 | 24.89 | 4717-4735 |
| AD-75145 | 8.73 | 1.94 | 4734-4752 |
| AD-75146 | 39.8 | 9.22 | 4751-4769 |
| AD-75147 | 44.81 | 9.36 | 4770-4788 |
| AD-75148 | 21.99 | 3.67 | 4780-4798 |
| AD-75149 | 56.19 | 8.99 | 4798-4816 |
| AD-75150 | 22.7 | 2.67 | 4815-4833 |
| AD-75151 | 33.03 | 2.82 | 4825-4843 |
| AD-75152 | 28.29 | 11.66 | 4884-4902 |
| AD-75153 | 34.14 | 6.63 | 4911-4929 |
| AD-75154 | 43.03 | 6.81 | 4987-5005 |
| AD-75155 | 10.11 | 2.68 | 5004-5022 |
| AD-75156 | 49.77 | 4.33 | 5016-5034 |
| AD-75157 | 10.55 | 1.54 | 5050-5068 |
| AD-75158 | 98.46 | 15.78 | 5098-5116 |
| AD-75159 | 59.88 | 7.14 | 5115-5133 |
| AD-75160 | 67.78 | 10.53 | 5127-5145 |
| AD-75161 | 71.58 | 12.59 | 5153-5171 |
| AD-75162 | 9.5 | 2.65 | 5171-5189 |
| AD-75163 | 99.59 | 10.77 | 5189-5207 |
| AD-75164 | 24.32 | 6.23 | 5206-5224 |
| AD-75165 | 48.65 | 10.6 | 5223-5241 |
| AD-75166 | 20.31 | 3.83 | 5238-5256 |
| AD-75167 | 96.76 | 8.31 | 5284-5302 |
| AD-75168 | 50.33 | 6.42 | 5301-5319 |
| AD-75169 | 35.41 | 3.61 | 5311-5329 |
| AD-75170 | 9.16 | 1.79 | 5328-5346 |
| AD-75171 | 74.55 | 6.92 | 5383-5401 |
| AD-75172 | 61.38 | 10.44 | 5391-5409 |
| AD-75173 | 18.61 | 2.81 | 5409-5427 |
| AD-75174 | 12.46 | 3.74 | 5412-5430 |
| AD-75175 | 64.04 | 8.99 | 5430-5448 |
| AD-75176 | 47.5 | 11.54 | 5505-5523 |
| AD-75177 | 26.63 | 1.26 | 5570-5588 |
| AD-75178 | 93.5 | 13.15 | 5603-5621 |
| AD-75179 | 13.82 | 1.72 | 5620-5638 |
| AD-75180 | 40.37 | 3.65 | 5628-5646 |
| AD-75181 | 68.1 | 14 | 5645-5663 |
| AD-75182 | 91.45 | 7.76 | 5659-5677 |
| AD-75183 | 52.7 | 9.56 | 5677-5695 |
| AD-75184 | 10.64 | 1.91 | 5694-5712 |
| AD-75185 | 22.43 | 3.75 | 5715-5733 |
| AD-75186 | 39.19 | 4.23 | 5740-5758 |
| AD-75187 | 80.34 | 23.05 | 5773-5791 |
| AD-75188 | 18.72 | 4.87 | 5790-5808 |
| AD-75189 | 71.77 | 15.33 | 5884-5902 |
| AD-75190 | 69.3 | 7.75 | 5917-5935 |
| AD-75191 | 13.99 | 6.28 | 5934-5952 |
| AD-75192 | 83.17 | 9.31 | 5942-5960 |
| AD-75193 | 79.66 | 18.37 | 5959-5977 |
| AD-75194 | 64.7 | 6.93 | 6066-6084 |
| AD-75195 | 79.21 | 5.63 | 6129-6147 |
| AD-75196 | 105.5 | 9.43 | 6147-6165 |
| AD-75197 | 128.21 | 12.85 | 6164-6182 |
| AD-75198 | 46.08 | 7.51 | 6231-6249 |
| AD-75199 | 117.2 | 7.51 | 6303-6321 |
| AD-75200 | 50.47 | 12.5 | 6346-6364 |
| AD-75201 | 59.91 | 14.09 | 6364-6382 |
| AD-75202 | 107.53 | 22.57 | 6382-6400 |
| AD-75203 | 25.97 | 4.96 | 6399-6417 |
| AD-75204 | 71.96 | 3.58 | 6444-6462 |
| AD-75205 | 39.19 | 13.83 | 6461-6479 |
| AD-75206 | 11.68 | 4.11 | 6479-6497 |
| AD-75207 | 40.79 | 10.66 | 6497-6515 |
| AD-75208 | 34.43 | 5.15 | 6517-6535 |
| AD-75209 | 107.98 | 25.75 | 6538-6556 |
| AD-75210 | 52.4 | 6.95 | 6557-6575 |
| AD-75211 | 90.01 | 19.17 | 6576-6594 |
| AD-75212 | 22.91 | 6.75 | 6594-6612 |
| AD-75213 | 87.12 | 9.51 | 6612-6630 |
| AD-75214 | 19.83 | 5.95 | 6629-6647 |

TABLE 19-continued

IGF-1 in vitro 10 nM screen

| Duplex Name | 10 nM AVG | 10 nM STD | Position in NM_000618.3 |
|---|---|---|---|
| AD-75215 | 50.88 | 6.82 | 6653-6671 |
| AD-75216 | 43.88 | 4.7 | 6722-6740 |
| AD-75217 | 18.19 | 2.83 | 6762-6780 |
| AD-75218 | 9.91 | 1.3 | 6806-6824 |
| AD-75219 | 54.72 | 5.78 | 6824-6842 |
| AD-75220 | 60.73 | 10.07 | 6841-6859 |
| AD-75221 | 23.15 | 1.19 | 6858-6876 |
| AD-75222 | 36.29 | 4.92 | 6870-6888 |
| AD-75223 | 21.88 | 2.24 | 6887-6905 |
| AD-75224 | 32.13 | 3.75 | 6910-6928 |
| AD-75225 | 12.65 | 3.49 | 6927-6945 |
| AD-75226 | 48.19 | 14.5 | 6944-6962 |
| AD-75227 | 58.51 | 8.21 | 6969-6987 |
| AD-75228 | 53.16 | 6.09 | 6986-7004 |
| AD-75229 | 10.94 | 2.92 | 7004-7022 |
| AD-75230 | 31.83 | 5.18 | 7035-7053 |
| AD-75231 | 15.75 | 2.98 | 7052-7070 |
| AD-75232 | 18.71 | 3.47 | 7078-7096 |
| AD-75233 | 106.56 | 8.46 | 7095-7113 |
| AD-75234 | 18.49 | 4.54 | 7112-7130 |
| AD-75235 | 113.68 | 22.34 | 7121-7139 |
| AD-75236 | 20.92 | 10.52 | 7144-7162 |
| AD-75237 | 29.1 | 4.1 | 7175-7193 |
| AD-75238 | 39.59 | 10.16 | 7210-7228 |
| AD-75239 | 23.08 | 3.81 | 7252-7270 |
| AD-75240 | 98.59 | 16.79 | 7269-7287 |
| AD-75241 | 109.49 | 8.89 | 7279-7297 |
| AD-75242 | 92.6 | 7.78 | 7296-7314 |

TABLE 20

Modified Sense and Antisense Strand Sequences of IGF-1 dsRNAs

| Duplex Name | Sense Oligo Name | SEQ ID NO | Sense sequence | Antisense Oligo Name | Antisense sequence | SEQ ID NO | mRNA target sequence | SEQ ID NO |
|---|---|---|---|---|---|---|---|---|
| AD-74963 | A-150432 | 2700 | UAGAUAAAUGUGAGGAUUUdTdT | A-150433 | AAAUCCUCACAUUUAUCUAdTdT | 2980 | UAGAUAAAUGUGAGGAUUU | 3260 |
| AD-74964 | A-150434 | 2701 | UUCUCUAAAUCCCUCUCUdTdT | A-150435 | AGAAGAGGGAUUUAGAGAAdTdT | 2981 | UUCUCUAAAUCCCUCUCU | 3261 |
| AD-74965 | A-150436 | 2702 | CUGUUUGCUAAAUCUCACUdTdT | A-150437 | AGUGAGAUUUAGCAAACAGdTdT | 2982 | CUGUUUGCUAAAUCUCACU | 3262 |
| AD-74966 | A-150438 | 2703 | CUCACUGUCACUGCUAAAUdTdT | A-150439 | AUUUAGCAGUGACAGUGAGdTdT | 2983 | CUCACUGUCACUGCUAAAU | 3263 |
| AD-74967 | A-150440 | 2704 | UUCAGAGCAGAUAGAGCCUdTdT | A-150441 | AGGCUCUAUCUGCUCUGAAdTdT | 2984 | UUCAGAGCAGAUAGAGCCU | 3264 |
| AD-74968 | A-150442 | 2705 | CAUUGCUCUCAACAUCUCCdTdT | A-150443 | UGAGAUGUUGAGAGCAAUGdTdT | 2985 | CAUUGCUCUCAACAUCUCC | 3265 |
| AD-74969 | A-150444 | 2706 | ACCAAUUCAUUUUCAGACUdTdT | A-150445 | AGUCUGAAAAUGAAUUGGUdTdT | 2986 | ACCAAUUCAUUUUCAGACU | 3266 |
| AD-74970 | A-150446 | 2707 | UUUGUACUUCAGAAGCAAUdTdT | A-150447 | AUUGCUUCUGAAGUACAAAdTdT | 2987 | UUUGUACUUCAGAAGCAAU | 3267 |
| AD-74971 | A-150448 | 2708 | AUGGGAAAAAUCAGCAGUCdTdT | A-150449 | UACUGCUGAUUUUUCCAUdTdT | 2988 | AUGGGAAAAAUCAGCAGUC | 3268 |
| AD-74972 | A-150450 | 2709 | CAAUUAUUUAAGUGCUGCUdTdT | A-150451 | AGCAGCACUUAAAUAAUUGdTdT | 2989 | CAAUUAUUUAAGUGCUGCU | 3269 |
| AD-74973 | A-150452 | 2710 | UUGAAGGUGAAGAUGCACAdTdT | A-150453 | UGUGCAUCUUCACCUUCAAdTdT | 2990 | UUGAAGGUGAAGAUGCACA | 3270 |
| AD-74974 | A-150454 | 2711 | UUUUAUUUCAACAAGCCCAdTdT | A-150455 | UGGGCUUGUUGAAAUAAAAdTdT | 2991 | UUUUAUUUCAACAAGCCCA | 3271 |
| AD-74975 | A-150456 | 2712 | CACAGGGUAUGGCGAGGCUdTdT | A-150457 | AGCCUCGCCAUACCCUGUGdTdT | 2992 | CACAGGGUAUGGCGAGGCU | 3272 |
| AD-74976 | A-150458 | 2713 | CAGCAGUCGAGGGCGCCUdTdT | A-150459 | AGGCGCCCUCGACUGCUGAdTdT | 2993 | CAGCAGUCGAGGGCGCCU | 3273 |
| AD-74977 | A-150460 | 2714 | UUGCGCACCCCUCAAGCCUdTdT | A-150461 | AGGCUUGAGGGGUGCGCAAdTdT | 2994 | UUGCGCACCCCUCAAGCCU | 3274 |
| AD-74978 | A-150462 | 2715 | UGCAGGAAACAAGAACUACdTdT | A-150463 | UUAGUUCUUGUUUCCUGCAdTdT | 2995 | UGCAGGAAACAAGAACUAC | 3275 |
| AD-74979 | A-150464 | 2716 | CAGGAUGUAGGAAGAGACCCUdTdT | A-150465 | AGGGUCUUCCUACAUCCUGdTdT | 2996 | CAGGAUGUAGGAAGAGACCCU | 3276 |
| AD-74980 | A-150466 | 2717 | UUAAACUUUGGAACACCUAdTdT | A-150467 | UAGGUGUUCCAAAGUUUAAdTdT | 2997 | UUAAACUUUGGAACACCUA | 3277 |
| AD-74981 | A-150468 | 2718 | AAAUAAGUUUGAUAAACAUUdTdT | A-150469 | AAUGUUUAUCAAACUUAUUUdTdT | 2998 | AAAUAAGUUUGAUAAACAUU | 3278 |
| AD-74982 | A-150470 | 2719 | UUAAAAGAUGGGCGUUUCCdTdT | A-150471 | UGAAACGCCCAUCUUUUAAdTdT | 2999 | UUAAAAGAUGGGCGUUUCC | 3279 |
| AD-74983 | A-150472 | 2720 | AAAUACACAAGUAAACAUUdTdT | A-150473 | AAUGUUUACUUGUGUAUUUdTdT | 3000 | AAAUACACAAGUAAACAUU | 3280 |
| AD-74984 | A-150474 | 2721 | UUCCAACAUUGUCUUUAGAdTdT | A-150475 | UCUAAAGACAAUGUUGGAAdTdT | 3001 | UUCCAACAUUGUCUUUAGG | 3281 |
| AD-74985 | A-150476 | 2722 | GGAGUGAUUUGCACCUUGAdTdT | A-150477 | UCAAGGUGCAAAUCACUCCdTdT | 3002 | GGAGUGAUUUGCACCUUGC | 3282 |

TABLE 20-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-74986 | A-150478 | AUUGCUGUUGAUCUUUAUdTdT | 2723 | A-150479 | AUAAAGAUCAACAGCAUdTdT | 3003 | AUUGCUGUUGAUCUUUAUAU | 3283 |
| AD-74987 | A-150480 | UCAAUAAUGUUCUAUAGAAdTdT | 2724 | A-150481 | UUCUAUAGAACAUUAUUGAdTdT | 3004 | UCAAUAAUGUUCUAUAGAA | 3284 |
| AD-74988 | A-150482 | AAAGAAAAAAAAAUAUAUdTdT | 2725 | A-150483 | AUAUAUUUUUUUUUCUUUdTdT | 3005 | AAAGAAAAAAAAAAUAUAU | 3285 |
| AD-74989 | A-150484 | AUAUAUAUAUAUCUUAAdTdT | 2726 | A-150485 | UUAAGAUAUAUAUAUAUdTdT | 3006 | AUAUAUAUAUAUAUCUUAG | 3286 |
| AD-74990 | A-150486 | UUUCCUUAUUUGCACUCUdTdT | 2727 | A-150487 | AGAGUGCAAAUAAGGAAAdTdT | 3007 | UUUCCUUAUUUGCACUCU | 3287 |
| AD-74991 | A-150488 | CUUUCUACAACUCGGAdTdT | 2728 | A-150489 | UCCCGAGUUGUGUAGAAAGdTdT | 3008 | CUUUCUACAACUCGGGC | 3288 |
| AD-74992 | A-150490 | GCUGUUUUACAGUGUdTdT | 2729 | A-150491 | ACACUGUAAAACAACAGCdTdT | 3009 | GCUGUUUUUACAGUGU | 3289 |
| AD-74993 | A-150492 | UUACAGUGUCUGAUAAUCUdTdT | 2730 | A-150493 | AGAUUAUCAGACACUGUAAdTdT | 3010 | UUACAGUGUCUGAUAAUCU | 3290 |
| AD-74994 | A-150494 | CUGAUAAUCUUGUUAGUCUdTdT | 2731 | A-150495 | AGACUAACAAGAUUAUCAGdTdT | 3011 | CUGAUAAUCUUGUUAGUCU | 3291 |
| AD-74995 | A-150496 | UAUACCCACCACCUCCCUUdTdT | 2732 | A-150497 | AAGGGAGGUGGUGGGUAUAdTdT | 3012 | UAUACCCACCACCUCCCUU | 3292 |
| AD-74996 | A-150498 | UUGCCGAAUUGGCCUCCUdTdT | 2733 | A-150499 | AGGAGGCCAAAUUCGGCAAdTdT | 3013 | UUGCCGAAUUUGGCCUCCU | 3293 |
| AD-74997 | A-150500 | GCCGAAUUGGCCUCCUCAdTdT | 2734 | A-150501 | UGAGGAGGCCAAAUUCGGCdTdT | 3014 | GCCGAAUUGGCCUCCUCA | 3294 |
| AD-74998 | A-150502 | AAAAGCAGCAGCAAGUCGUdTdT | 2735 | A-150503 | ACGACUUGCUGCUGCUUUUdTdT | 3015 | AAAAGCAGCAGCAAGUCGU | 3295 |
| AD-74999 | A-150504 | GUCAAGAAGCACCACCAUUdTdT | 2736 | A-150505 | AAUGGUGGUGCUUCUUGACdTdT | 3016 | GUCAAGAAGCACCACCAUU | 3296 |
| AD-75000 | A-150506 | AGUUGGAUGCAUUUUAUUdTdT | 2737 | A-150507 | AAAUAAAAUGCAUCCAACUdTdT | 3017 | AGUUGGAUGCAUUUUAUUU | 3297 |
| AD-75001 | A-150508 | UUAGACACAAAGCUUUAUUdTdT | 2738 | A-150509 | AAUUAAAGCUUUGUGUCUAAdTdT | 3018 | UUAGACACAAAGCUUUAUU | 3298 |
| AD-75002 | A-150510 | CACAUCAUGCUUACAAAAAdTdT | 2739 | A-150511 | UUUUUGUAAGCAUGAUGUGdTdT | 3019 | CACAUCAUGCUUACAAAAA | 3299 |
| AD-75003 | A-150512 | AAGAAUAAAUGCAAAUAGUUdTdT | 2740 | A-150513 | AACUAUUUGCAUUUAUUCUUdTdT | 3020 | AAGAAUAAAUGCAAAUAGUU | 3300 |
| AD-75004 | A-150514 | UGCAACUUUGAGGCCAAUdTdT | 2741 | A-150515 | UAUUGGCCUCAAAGUUGCAdTdT | 3021 | UGCAACUUUGAGGCCAAUC | 3301 |
| AD-75005 | A-150516 | CAUUUUUAGGCAUAUGUUUdTdT | 2742 | A-150517 | AAACAUAUGCCUAAAAAUGdTdT | 3022 | CAUUUUUAGGCAUAUGUUU | 3302 |
| AD-75006 | A-150518 | UUAAACAUAGAAAGUUUCUdTdT | 2743 | A-150519 | AGAAACUUUCUAUGUUUAAdTdT | 3023 | UUAAACAUAGAAAGUUUCU | 3303 |
| AD-75007 | A-150520 | CUUCAACUCAAAAGAGUUCdTdT | 2744 | A-150521 | UAACUCUUUUGAGUUGAAGdTdT | 3024 | CUUCAACUCAAAAGAGUUC | 3304 |
| AD-75008 | A-150522 | UCCUUCAAUGAUGAGUAdTdT | 2745 | A-150523 | UAACUCUAUCAUUUGAAGGdTdT | 3025 | UCCUUCAAUGAUGAGUAGUA | 3305 |

TABLE 20-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-75009 | A-150524 | UUAGUAACUUUCCUCUUUdTdT | 2746 | A-150525 | AAAAGAGAGAAAGUUACUAAdTdT | 3026 | UUAGUAACUUUCCUCUUUU | 3306 |
| AD-75010 | A-150526 | UUUUCCAUAUAGAGCACUdTdT | 2747 | A-150527 | AGUGCUCUAUAUGGAAAAdTdT | 3027 | UUUUCCAUAUAGAGCACU | 3307 |
| AD-75011 | A-150528 | CUAUGUAAAUUUAGCAUAUdTdT | 2748 | A-150529 | AUAUGCUAAAUUUACAUAGdTdT | 3028 | CUAUGUAAAUUUAGCAUAU | 3308 |
| AD-75012 | A-150530 | AUCAAUUAUACAGGAUAUAdTdT | 2749 | A-150531 | UAUAUCCUGUAUAAUUGAUdTdT | 3029 | AUCAAUUAUACAGGAUAUA | 3309 |
| AD-75013 | A-150532 | UUUAGUAUAAUGGUGCUAUdTdT | 2750 | A-150533 | AUAGCACCAUUAUACUAAAdTdT | 3030 | UUUAGUAUAAUGGUGCUAU | 3310 |
| AD-75014 | A-150534 | UGUUAUAUGAAAGAGUCUdTdT | 2751 | A-150535 | AGACUCUUUCAUAUAACAAdTdT | 3031 | UGUUAUAUGAAAGAGUCU | 3311 |
| AD-75015 | A-150536 | ACGGUAAUACGUGAAAGCAdTdT | 2752 | A-150537 | UGCUUUCACGUAUUACCGUdTdT | 3032 | ACGGUAAUACGUGAAAGCA | 3312 |
| AD-75016 | A-150538 | AAAACAAUAGGGGAAGCCUdTdT | 2753 | A-150539 | AGGCUUCCCCUAUUGUUUUdTdT | 3033 | AAAACAAUAGGGGAAGCCU | 3313 |
| AD-75017 | A-150540 | UACUGAAAACACCAUCCAUdTdT | 2754 | A-150541 | AUGGAUGGUGUUUUCAGUAdTdT | 3034 | UACUGAAAACACCAUCCAU | 3314 |
| AD-75018 | A-150542 | UGGGGAAAGAAGGCAAAGUdTdT | 2755 | A-150543 | ACUUUGCCUUCUUUCCCAAdTdT | 3035 | UGGGGAAAGAAGGCAAAGU | 3315 |
| AD-75019 | A-150544 | UCAGACACCAAAAGUCCACdTdT | 2756 | A-150545 | AGUGGACUUUUGGUGUCUGAdTdT | 3036 | UCAGACACCAAAAGUCCAC | 3316 |
| AD-75020 | A-150546 | CGAGUCCAGAGGAAAACUdTdT | 2757 | A-150547 | AGUUUCCUCUCUGGACUCGdTdT | 3037 | CGAGUCCAGAGGAAAACU | 3317 |
| AD-75021 | A-150548 | AAACUGUGGAAUGGAAAAdTdT | 2758 | A-150549 | UUUUCCAUUCCACAGUUUdTdT | 3038 | AAACUGUGGAAUGGAAAAA | 3318 |
| AD-75022 | A-150550 | AGCAGAAGGCUAGGAAUUUdTdT | 2759 | A-150551 | AAAAUUCCUAGCCUUCUGCdTdT | 3039 | AGCAGAAGGCUAGGAAUUU | 3319 |
| AD-75023 | A-150552 | UUAGCAGUCCUGGUUUCUUdTdT | 2760 | A-150553 | AAGAAACCAGGACUGCUAAdTdT | 3040 | UUAGCAGUCCUGGUUUCUU | 3320 |
| AD-75024 | A-150554 | CAAAAUGGGGCAAUAUGUdTdT | 2761 | A-150555 | ACAUAUUGCCCCAUUUUGdTdT | 3041 | CAAAAUGGGGCAAUAUGU | 3321 |
| AD-75025 | A-150556 | UUUAAAAAGAUAAAGAUUCdTdT | 2762 | A-150557 | UAAUCUUUAUCUUUUUAAAdTdT | 3042 | UUUAAAAAGAUAAAGAUUC | 3322 |
| AD-75026 | A-150558 | UCAGAUUUUUUUACCCUGdTdT | 2763 | A-150559 | UAGGGUAAAAAAAAUCGAdTdT | 3043 | UCAGAUUUUUUUUACCCUG | 3323 |
| AD-75027 | A-150560 | UUUUUUACCCUGGGUUGCUdTdT | 2764 | A-150561 | AGCAACCCAGGGUAAAAAAdTdT | 3044 | UUUUUACCCUGGGUUGCU | 3324 |
| AD-75028 | A-150562 | CUGUAAGGGUGCAACAUCAdTdT | 2765 | A-150563 | UGAUGUUGCACCCUUACAGdTdT | 3045 | CUGUAAGGGUGCAACAUCA | 3325 |
| AD-75029 | A-150564 | CUGAGAUGCAAGGAAUUCUdTdT | 2766 | A-150565 | AGAAUUCCUUGCAUCUCAGdTdT | 3046 | CUGAGAUGCAAGGAAUUCU | 3326 |
| AD-75030 | A-150566 | UGGGUGAAUUGAAUGCUCCdTdT | 2767 | A-150567 | UGAGCAUUCAAUUCACCCAdTdT | 3047 | UGGGUGAAUUGAAUGCUCC | 3327 |
| AD-75031 | A-150568 | UUCUUGUCAGUGAAGCUAUdTdT | 2768 | A-150569 | AUAGCUUCACUGACAAGAAdTdT | 3048 | UUCUUGUCAGUGAAGCUAU | 3328 |
| AD-75032 | A-150570 | AAUAACUGGCCAACUAGUUdTdT | 2769 | A-150571 | AACUAGUUGGCCAGUUAUUdTdT | 3049 | AAUAACUGGCCAACUAGUU | 3329 |

TABLE 20-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-75033 | A-150572 | UGUUAAAGCUAACAGCUAdTdT | 2770 | A-150573 | UAGCUGUUAGCUUUUAACAdTdT | 3050 | UGUUAAAGCUAACAGCUC | 3330 |
| AD-75034 | A-150574 | CAAUCUCUUAAAACACUUUdTdT | 2771 | A-150575 | AAAGUGUUUUAAGAGAUUGdTdT | 3051 | CAAUCUCUUAAAACACUUU | 3331 |
| AD-75035 | A-150576 | AAAAUAUGUGGGAAGCAUUdTdT | 2772 | A-150577 | AAUGCUUCCCACAUAUUUUdTdT | 3052 | AAAAUAUGUGGGAAGCAUU | 3332 |
| AD-75036 | A-150578 | UUUGAUUUUCAAUUUGAUUdTdT | 2773 | A-150579 | AAUCAAAUUGAAAAUCAAAdTdT | 3053 | UUUGAUUUUCAAUUUGAUU | 3333 |
| AD-75037 | A-150580 | UUGAAUUCUGCAUUUGGUUdTdT | 2774 | A-150581 | AACCAAAUGCAGAAUUCAAdTdT | 3054 | UUGAAUUCUGCAUUUGGUU | 3334 |
| AD-75038 | A-150582 | UUUAUGAAUACAAAGAUAAdTdT | 2775 | A-150583 | UUAUCUUUGUAUUCAUAAAdTdT | 3055 | UUUAUGAAUACAAAGAUAA | 3335 |
| AD-75039 | A-150584 | GUGAAAAGAGAGAAGGAAdTdT | 2776 | A-150585 | UUCCUUCUCUCUUUUCACdTdT | 3056 | GUGAAAAGAGAGAAGGAA | 3336 |
| AD-75040 | A-150586 | AAAGAAAAAGGAGAAAAACdTdT | 2777 | A-150587 | GUUUUUCUCCUUUUUCUUUdTdT | 3057 | AAAGAAAAAGGAGAAAAAC | 3337 |
| AD-75041 | A-150588 | ACAAAGAGAUUUCUACCAGdTdT | 2778 | A-150589 | UUGGUAGAAAUCUCUUUGUdTdT | 3058 | ACAAAGAGAUUUCUACCAG | 3338 |
| AD-75042 | A-150590 | UUGUAGCACUCACUGACUdTdT | 2779 | A-150591 | AGUCAGUGAGUGCUAACAdTdT | 3059 | UUGUAGCACUCACUGACU | 3339 |
| AD-75043 | A-150592 | UACAUAUCUAGUAAAACCUdTdT | 2780 | A-150593 | AGGUUUUACUAGAUAUGUAdTdT | 3060 | UACAUAUCUAGUAAAACCU | 3340 |
| AD-75044 | A-150594 | CUCGUUUAAUAUACUAUAAdTdT | 2781 | A-150595 | AUUAUAGUAUAUUAAACGAGdTdT | 3061 | CUCGUUUAAUAUACUAUAAU | 3341 |
| AD-75045 | A-150596 | UUUAUAUCUAUAAAUAAUAdTdT | 2782 | A-150597 | UAUUAUUUAUAGAUAUAAAdTdT | 3062 | UUUAUAUCUAUAAAUAAUA | 3342 |
| AD-75046 | A-150598 | UAUUCUAUUCCAUUUGAAAdTdT | 2783 | A-150599 | UUUCAAAUGGAAUAGAAUAdTdT | 3063 | UAUUCUAUUCCAUUUGAAA | 3343 |
| AD-75047 | A-150600 | UUUGAAAAACACAAUGAUUdTdT | 2784 | A-150601 | AAUCAUUGUGUUUUUCAAAdTdT | 3064 | UUUGAAAAACACAAUGAUU | 3344 |
| AD-75048 | A-150602 | AAGGAAAGUGAUCCAAAAUdTdT | 2785 | A-150603 | AUUUUGGAUCACUUUCCUUdTdT | 3065 | AAGGAAAGUGAUCCAAAAU | 3345 |
| AD-75049 | A-150604 | UUUGAAAAUAUUAAAAUAAUdTdT | 2786 | A-150605 | AUAUUUUAAUAUUUUCAAAdTdT | 3066 | UUUGAAAAUAUUAAAAUAAU | 3346 |
| AD-75050 | A-150606 | UAAAAUAUAAUAUCUAAUAAdTdT | 2787 | A-150607 | UAUUAGAUAUUAUAUUUAAdTdT | 3067 | UAAAAUAUAAUAUCUAAUAA | 3347 |
| AD-75051 | A-150608 | AAAAGUCACAAAGUUAUCUdTdT | 2788 | A-150609 | AGAUAACUUUGUGACUUUUdTdT | 3068 | AAAAGUCACAAAGUUAUCU | 3348 |
| AD-75052 | A-150610 | UUCUUUAACAAACUUUACUdTdT | 2789 | A-150611 | AGUAAAGUUUGUUAAAGAAdTdT | 3069 | UUCUUUAACAAACUUUACU | 3349 |
| AD-75053 | A-150612 | CUCUUAAUUCUUAGCUGUAUdTdT | 2790 | A-150613 | AUACAGCUAAGAAUAAGAGdTdT | 3070 | CUCUUAAUUCUUAGCUGUAU | 3350 |
| AD-75054 | A-150614 | AUAUACAUUUUUUAAAAGdTdT | 2791 | A-150615 | CUUUUAAAAAAAAUGUAUAUdTdT | 3071 | AUAUACAUUUUUUAAAAG | 3351 |
| AD-75055 | A-150616 | CAUUUUUUAAAAGUUUGUdTdT | 2792 | A-150617 | ACAAACUUUUAAAAAAUGdTdT | 3072 | CAUUUUUUAAAAGUUUGU | 3352 |

TABLE 20-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-75056 | A-150618 | GUUAAAAUAUGCUUGACUAdTdT | 2793 | A-150619 | UAGUCAAGCAUAUUUUAACdTdT | 3073 | GUUAAAUAUGCUUGACUA | 3353 |
| AD-75057 | A-150620 | AUGCUUGACUAGAGUUUCAdTdT | 2794 | A-150621 | UGAAACUCUAGUCAAGCAUdTdT | 3074 | AUGCUUGACUAGAGUUCC | 3354 |
| AD-75058 | A-150622 | CAGUUGAAAGGCAAAAACUdTdT | 2795 | A-150623 | AGUUUUGCCUUUCAACUGdTdT | 3075 | CAGUUGAAAGGCAAAAACU | 3355 |
| AD-75059 | A-150624 | UCCAUCACAACAAGAAAUdTdT | 2796 | A-150625 | AUUUUCUUGUUGUGAUGGAAdTdT | 3076 | UCCAUCACAACAAGAAAU | 3356 |
| AD-75060 | A-150626 | UUGGUAUCAAGAAAGUCCAdTdT | 2797 | A-150627 | UGGACUUUCUUGAUACCAAdTdT | 3077 | UUGGUAUCAAGAAAGUCCA | 3357 |
| AD-75061 | A-150628 | GUUAGUGUACUAGUCCAUdTdT | 2798 | A-150629 | UAUGGACUAGUACACUAdTdT | 3078 | GUUAGUGUACUAGUCCAUC | 3358 |
| AD-75062 | A-150630 | CAUAGCCUAGAAAAUGAUdTdT | 2799 | A-150631 | UAUCAUUUUCUAGGCUAUGdTdT | 3079 | CAUAGCCUAGAAAAUGAUC | 3359 |
| AD-75063 | A-150632 | UCCCUAUCUGCAGAUCAAdTdT | 2800 | A-150633 | UUUGAUCUGCAGAUAGGGAdTdT | 3080 | UCCCUAUCUGCAGAUCAAG | 3360 |
| AD-75064 | A-150634 | UUAUCCAGCAUUCAGAUCUdTdT | 2801 | A-150635 | AGAUCUGAAUGCUGGAUAAdTdT | 3081 | UUAUCCAGCAUUCAGAUCU | 3361 |
| AD-75065 | A-150636 | UUUUUGGUUAAAAGUACCAdTdT | 2802 | A-150637 | UGGUACUUUUAACCAAAAdTdT | 3082 | UUUUUGGUUAAAAGUACCC | 3362 |
| AD-75066 | A-150638 | UACCCAGGCCUUGAUUAUUUdTdT | 2803 | A-150639 | AAAUAAUCAAGCCUGGGUAdTdT | 3083 | UACCCAGGCCUUGAUUAUUU | 3363 |
| AD-75067 | A-150640 | UCAUGCAAAUCUAUAUUUdTdT | 2804 | A-150641 | AAAAUAUAGAAUUUGCAUGAdTdT | 3084 | UCAUGCAAAUCUAUAUUU | 3364 |
| AD-75068 | A-150642 | UUACAUUCUUGGAAAGUCUdTdT | 2805 | A-150643 | AGACUUUCCAAGAAUGUAAdTdT | 3085 | UUACAUUCUUGGAAAGUCU | 3365 |
| AD-75069 | A-150644 | UCUUGGAAAGUCUAUAUGAdTdT | 2806 | A-150645 | UCAUAUAGACUUUCCAAGAdTdT | 3086 | UCUUGGAAAGUCUAUAUGA | 3366 |
| AD-75070 | A-150646 | AAAAACAAAAAUAACAUCdTdT | 2807 | A-150647 | AGAUGUUAUUUUUGUUUUUdTdT | 3087 | AAAAACAAAAAUAACAUCU | 3367 |
| AD-75071 | A-150648 | UUCUCCCACUGGUCACCUdTdT | 2808 | A-150649 | AGGUGACCCAGUGGGAGAAdTdT | 3088 | UUCUCCCACUGGUCACCU | 3368 |
| AD-75072 | A-150650 | CAAGGAUCAGAGGCCAGGAdTdT | 2809 | A-150651 | UCCUGGCCUCUGAUCCUUGdTdT | 3089 | CAAGGAUCAGAGGCCAGGA | 3369 |
| AD-75073 | A-150652 | AAAAAAAAAAAAAAGACUCdTdT | 2810 | A-150653 | UAGUCUUUUUUUUUUUUUdTdT | 3090 | AAAAAAAAAAAAAAGACUC | 3370 |
| AD-75074 | A-150654 | UCCCUGGAUCUCUGAAUAUdTdT | 2811 | A-150655 | AUAUUCAGAGAUCCAGGGAdTdT | 3091 | UCCCUGGAUCUCUGAAUAU | 3371 |
| AD-75075 | A-150656 | AUAUGCAAAAGAAGGCCdTdT | 2812 | A-150657 | UGGCCUUCUUUUGCAUAUdTdT | 3092 | AUAUGCAAAAGAAGGCCC | 3372 |
| AD-75076 | A-150658 | UAGUGGAGCCAGCAAUCCUdTdT | 2813 | A-150659 | AGGAUUGCUGGCUCCACUAdTdT | 3093 | UAGUGGAGCCAGCAAUCCU | 3373 |
| AD-75077 | A-150660 | UUAACUCUCAGUCCAACAUdTdT | 2814 | A-150661 | AUGUUGGACUGAGAGUUAAdTdT | 3094 | UUAACUCUCAGUCCAACAU | 3374 |
| AD-75078 | A-150662 | UUAUUUGAAUUGAGCACCUdTdT | 2815 | A-150663 | AGGUGCUCAAUUCAAAUAAdTdT | 3095 | UUAUUUGAAUUGAGCACCU | 3375 |
| AD-75079 | A-150664 | CAGAUGUAAAGAAACUAUdTdT | 2816 | A-150665 | AUAGUUUCUUUACAUCUGdTdT | 3096 | CAGAUGUAAAGAAACUAU | 3376 |

TABLE 20-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-75080 | A-150666 | AUACAUCAUUUGCCCUAdTdT | 2817 | A-150667 | UAGGGCAAAAUGAUGAUdTdT | 3097 | AUACAUCAUUUUGCCCUC | 3377 |
| AD-75081 | A-150668 | UUUUGCCCUCUGCCUGUUUdTdT | 2818 | A-150669 | AAACAGGCAGAGGGCAAAAdTdT | 3098 | UUUUGCCCUCUGCCUGUUU | 3378 |
| AD-75082 | A-150670 | UUCCAGACAUACAGGUUCUdTdT | 2819 | A-150671 | AGAACCUGUAUGUCUGGAAdTdT | 3099 | UUCCAGACAUACAGGUUCU | 3379 |
| AD-75083 | A-150672 | CUGUGGAAUAAGAUACUGGdTdT | 2820 | A-150673 | UCAGUACUUAUUCCACAGdTdT | 3100 | CUGUGGAAUAAGAUACUGG | 3380 |
| AD-75084 | A-150674 | UAAGAUACUGGACUCCUCUdTdT | 2821 | A-150675 | AGAGGAGUCCAGUAUCUUAdTdT | 3101 | UAAGAUACUGGACUCCUCU | 3381 |
| AD-75085 | A-150676 | CUUCCCAAGAUGGCACUUAdTdT | 2822 | A-150677 | UAAGUGCCAUCUGGGAAGdTdT | 3102 | CUUCCCAAGAUGGCACUUC | 3382 |
| AD-75086 | A-150678 | GUGUACCUUUUAAAAUUAUdTdT | 2823 | A-150679 | AUAAUUUUAAAAGGUACACdTdT | 3103 | GUGUACCUUUUAAAAUUAU | 3383 |
| AD-75087 | A-150680 | UUCCCUCUCAACAAAACUUdTdT | 2824 | A-150681 | AAGUUUUGUUGAGAGGGAAdTdT | 3104 | UUCCCUCUCAACAAAACUU | 3384 |
| AD-75088 | A-150682 | UUUAUAGGCAGUCUUCUGCdTdT | 2825 | A-150683 | UCAGAAGACUGCCUAUAAAdTdT | 3105 | UUUAUAGGCAGUCUUCUGC | 3385 |
| AD-75089 | A-150684 | UUUUCUGUCAUAGUUAGAUdTdT | 2826 | A-150685 | AUCUAACUAUGACAGAAAAdTdT | 3106 | UUUUCUGUCAUAGUUAGAU | 3386 |
| AD-75090 | A-150686 | AUGUGAUAAUUCUAAGAGUdTdT | 2827 | A-150687 | ACUCUUAGAAUUAUCACAUdTdT | 3107 | AUGUGAUAAUUCUAAGAGU | 3387 |
| AD-75091 | A-150688 | UCCCUCACUUAAUUCUAUdTdT | 2828 | A-150689 | AUAGAAUUAAGUGAAGGAAdTdT | 3108 | UCCCUCACUUAAUUCUAU | 3388 |
| AD-75092 | A-150690 | AUUAUCUUUCUAACUUUUdTdT | 2829 | A-150691 | AAAAGUUAAGAAAGAUAAUdTdT | 3109 | AUUAUCUUUCUAACUUUU | 3389 |
| AD-75093 | A-150692 | UUCCAACACAUAAUCCUCUdTdT | 2830 | A-150693 | AGAGGAUUAUGUGUUGGAAdTdT | 3110 | UUCCAACACAUAAUCCUCU | 3390 |
| AD-75094 | A-150694 | AAAUAAAUUGAAAAUAACUdTdT | 2831 | A-150695 | AGUUAUUUUCAAUUUAUUUdTdT | 3111 | AAAUAAAUUGAAAAUAACU | 3391 |
| AD-75095 | A-150696 | UCAUUAUACCAAUUCACUAdTdT | 2832 | A-150697 | UAGUGAAUUGGUAUAAUGAdTdT | 3112 | UCAUUAUACCAAUUCACUA | 3392 |
| AD-75096 | A-150698 | AUUUAUAUUUUUAAUGAAUdTdT | 2833 | A-150699 | AUUCAUUAAAAAUAUAAAUdTdT | 3113 | AUUUAUAUUUUUAAUGAAU | 3393 |
| AD-75097 | A-150700 | UAAAACUAGAAAACAAAUdTdT | 2834 | A-150701 | AUUUGUUUUCUAGUUUUAAdTdT | 3114 | UAAAACUAGAAAACAAAU | 3394 |
| AD-75098 | A-150702 | UUGAUUACUAUAUACUACAdTdT | 2835 | A-150703 | UGUAGUAUAUAGUAAUCAAdTdT | 3115 | UUGAUUACUAUAUACUACA | 3395 |
| AD-75099 | A-150704 | AUGACUCAGAUUCAUGAGAdTdT | 2836 | A-150705 | UCUAUGAAUCUGAGUCAUdTdT | 3116 | AUGACUCAGAUUCAUGAGA | 3396 |
| AD-75100 | A-150706 | AAAGGAGCAACCAAAAUGUdTdT | 2837 | A-150707 | ACAUUUUGGUUGCUCCUUUdTdT | 3117 | AAAGGAGCAACCAAAAUGU | 3397 |
| AD-75101 | A-150708 | GUCACAACCCAAAACUUUAdTdT | 2838 | A-150709 | UAAAGUUUUGGGUUGUGACdTdT | 3118 | GUCACAACCCAAAACUUUA | 3398 |
| AD-75102 | A-150710 | AAACUUUACAAGCUUUGCUdTdT | 2839 | A-150711 | AGCAAAGCUUGUAAAGUUUdTdT | 3119 | AAACUUUACAAGCUUUGCU | 3399 |

TABLE 20-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-75103 | A-150712 | UUCAGAAUUAGAUUGCUUUdTdT | 2840 | A-150713 | AAAGCAAUCUAAUUCUGAAdTdT | 3120 | UUCAGAAUUAGAUUGCUUU | 3400 |
| AD-75104 | A-150714 | UUAUAAUUCUUGAAUGAGGAdTdT | 2841 | A-150715 | UCUCAUUCAAGAAUUAUAAdTdT | 3121 | UUAUAAUUCUUGAAUGAGG | 3401 |
| AD-75105 | A-150716 | UAAUUCUUGAAUGAGGCAAdTdT | 2842 | A-150717 | UUGCCCAUUCAAGAAUUAdTdT | 3122 | UAAUUCUUGAAUGAGGCAA | 3402 |
| AD-75106 | A-150718 | AUUUCAAGAUAUUUGUAAAdTdT | 2843 | A-150719 | UUUACAAAUAUCUUGAAAUdTdT | 3123 | AUUUCAAGAUAUUUGUAAA | 3403 |
| AD-75107 | A-150720 | AGAACAGUAAACAUUGUdTdT | 2844 | A-150721 | ACCAAUGUUUACUGUUCUUdTdT | 3124 | AGAACAGUAAACAUUGU | 3404 |
| AD-75108 | A-150722 | UUUCAACUCAUAGGCUUAUdTdT | 2845 | A-150723 | AUAAGCCUAUGAGUUGAAAdTdT | 3125 | UUUCAACUCAUAGGCUUAU | 3405 |
| AD-75109 | A-150724 | UUGACCAUACUGGAUACUUdTdT | 2846 | A-150725 | AAGUAUCCAGUAUGGUCAAdTdT | 3126 | UUGACCAUACUGGAUACUU | 3406 |
| AD-75110 | A-150726 | UUUAGAUGAGGCAGUCCdTdT | 2847 | A-150727 | UGAACUGCCUCAUCUUUAAAdTdT | 3127 | UUUAGAUGAGGCAGUCC | 3407 |
| AD-75111 | A-150728 | CAUCAGAAUCCACUCUCUdTdT | 2848 | A-150729 | AGAGAGUGGAUUCUGAUGdTdT | 3128 | CAUCAGAAUCCACUCUCU | 3408 |
| AD-75112 | A-150730 | UAGGGAUCCUUAGGGUGAAdTdT | 2849 | A-150731 | AGAGAUUUUCAUAUCCCUAdTdT | 3129 | UAGGGAUAUGAACAUCCU | 3409 |
| AD-75113 | A-150732 | UUCACCCUUAAGGAUCCAUdTdT | 2850 | A-150733 | AUUGGAUCCUUAAGGGUGAAdTdT | 3130 | UUCACCCUUAAGGAUCCAU | 3410 |
| AD-75114 | A-150734 | AUGGAAUACUGAAAAGAAAdTdT | 2851 | A-150735 | UUUCUUUUCAGUAUUCCAUdTdT | 3131 | AUGGAAUACUGAAAAGAAA | 3411 |
| AD-75115 | A-150736 | GAAUACUGAAAAGAAAUCAdTdT | 2852 | A-150737 | UGAUUUCUUUUCAGUAUUCdTdT | 3132 | GAAUACUGAAAAGAAAUCA | 3412 |
| AD-75116 | A-150738 | ACUUCCUUGAAAAAUUUAUdTdT | 2853 | A-150739 | AUAAAAUUUUCAAGGAAGUdTdT | 3133 | ACUUCCUUGAAAAAUUUAU | 3413 |
| AD-75117 | A-150740 | UUAAAAAACAAACAAdTdT | 2854 | A-150741 | UUGUUUGUUUUUUUAAdTdT | 3134 | UUAAAAAACAAACAAACAA | 3414 |
| AD-75118 | A-150742 | AAACAAAAAGCCUGUCCAAdTdT | 2855 | A-150743 | UUGGACAGGCUUUUUGUUUdTdT | 3135 | AAACAAAAAGCCUGUCCAC | 3415 |
| AD-75119 | A-150744 | UUUGUGUAGAUGAAACCAUdTdT | 2856 | A-150745 | AUGGUUUCAUCUACACAAAdTdT | 3136 | UUUGUGUAGAUGAAACCAU | 3416 |
| AD-75120 | A-150746 | UUGGGAGAAGGCUUAGAAUdTdT | 2857 | A-150747 | AUUCUAAGCCUUCUCCCAAdTdT | 3137 | UUGGGAGAAGGCUUAGAAU | 3417 |
| AD-75121 | A-150748 | UAAAAGAUGUAGCACAUUdTdT | 2858 | A-150749 | AAAAUGUGCUACAUCUUUAdTdT | 3138 | UAAAAGAUGUAGCACAUUU | 3418 |
| AD-75122 | A-150750 | UUAUUGUUUGGCCAGCUAUdTdT | 2859 | A-150751 | AUAGCUGGCCAAACAAUAAdTdT | 3139 | UUAUUGUUUGGCCAGCUAU | 3419 |
| AD-75123 | A-150752 | AUGCCAAUGUGGUGCUAUdTdT | 2860 | A-150753 | AAUAGCACCACAUUGGCAUdTdT | 3140 | AUGCCAAUGUGGUGCUAU | 3420 |
| AD-75124 | A-150754 | AAUGUGGUGCUAUUGUUUCdTdT | 2861 | A-150755 | UAAACAAUAGCACCACAUUdTdT | 3141 | AAUGUGGUGCUAUUGUUUC | 3421 |
| AD-75125 | A-150756 | CUUUAAGAAAGUACUUGACdTdT | 2862 | A-150757 | UUCAAGUACUUUCUUAAAGdTdT | 3142 | CUUUAAGAAAGUACUUGAC | 3422 |
| AD-75126 | A-150758 | CUAAAAAAAAAGAAAAAAdTdT | 2863 | A-150759 | UUUUUCUUUUUUUUUUAGdTdT | 3143 | CUAAAAAAAAAGAAAAAA | 3423 |

TABLE 20-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-75127 | A-150760 | AAGAAAAAAAGAAAGCAUdTdT | 2864 | A-150761 | AUGCUUUCUUUUUUUCUUdTdT | 3144 | AAGAAAAAAAGAAAGCAU | 3424 |
| AD-75128 | A-150762 | AUAGACAUAUUUUUUAAAdTdT | 2865 | A-150763 | UUUAAAAAAAUAUGUCUAUdTdT | 3145 | AUAGACAUAUUUUUUAAA | 3425 |
| AD-75129 | A-150764 | UUAAAGUAUAAAAACAACAdTdT | 2866 | A-150765 | UGUUGUUUUAUACUUUAAdTdT | 3146 | UUAAAGUAUAAAAACAACA | 3426 |
| AD-75130 | A-150766 | CAAUUCUAUAGAAUGAUdTdT | 2867 | A-150767 | UCAUCUAUAGAAUUGAdTdT | 3147 | CAAUUCUAUAGAAUGAUGG | 3427 |
| AD-75131 | A-150768 | GGCUUAAUAAAAAUAGCAUdTdT | 2868 | A-150769 | AAUGCUAUUUUUAUUAAGCCAdTdT | 3148 | GGCUUAAUAAAAAUAGCAU | 3428 |
| AD-75132 | A-150770 | UAAUAAAAAUAGCAUUAGUdTdT | 2869 | A-150771 | ACCUAAUGCUAUUUUUAUUAdTdT | 3149 | UAAUAAAAAUAGCAUUAGU | 3429 |
| AD-75133 | A-150772 | UAUCUAGCCACCACCACCUdTdT | 2870 | A-150773 | AGGUGGUGGUGGCUAGAUAdTdT | 3150 | UAUCUAGCCACCACCACCU | 3430 |
| AD-75134 | A-150774 | UUUAUCUCUCACAAGUAGUdTdT | 2871 | A-150775 | ACUACUUGUGAGUGAUAAAdTdT | 3151 | UUUAUCUCACAAGUAGU | 3431 |
| AD-75135 | A-150776 | GGCAGGAGUUGGAAAUUUdTdT | 2872 | A-150777 | AAAAUUUCCAACUCCUGCCAdTdT | 3152 | GGCAGGAGUUGGAAAUUU | 3432 |
| AD-75136 | A-150778 | UUUAAAGUAGAAGGCCUCdTdT | 2873 | A-150779 | UGAGCCUUCUACUUUAAAdTdT | 3153 | UUUAAAGUAGAAGGCCUCC | 3433 |
| AD-75137 | A-150780 | CCAUUGUUUGUGGCUCUdTdT | 2874 | A-150781 | AGAGCCAACAAACAAUGGAdTdT | 3154 | CCAUUGUUUGUGGCUCU | 3434 |
| AD-75138 | A-150782 | UUAGCAAAAUAGCAAUAUdTdT | 2875 | A-150783 | AUAUUGCUAAUUUUGCUAAdTdT | 3155 | UUAGCAAAAUAGCAAUAU | 3435 |
| AD-75139 | A-150784 | AUAUUACCAAUCUUCUGAdTdT | 2876 | A-150785 | UCAGAAGAUUGGAUAAUAdTdT | 3156 | AUAUUACCAAUCUUCUGA | 3436 |
| AD-75140 | A-150786 | UAUCCAAUCUUCUGAACUdTdT | 2877 | A-150787 | AGUUCAGAAGAUUGGAUAdTdT | 3157 | UAUCCAAUCUUCUGAACU | 3437 |
| AD-75141 | A-150788 | AAGAGCAUGGAGAUAAACdTdT | 2878 | A-150789 | GUUUAUCUCCAUGCUCUUdTdT | 3158 | AAGAGCAUGGAGAUAAAC | 3438 |
| AD-75142 | A-150790 | ACGCGGGAAAAAAGAUCUUdTdT | 2879 | A-150791 | AAGAUCUUUUUCCCGCGUdTdT | 3159 | ACGCGGGAAAAAAGAUCUU | 3439 |
| AD-75143 | A-150792 | GAUCUUAUAGGCAAAUAGAdTdT | 2880 | A-150793 | UCUAUUUGCCUAUAAGAUCdTdT | 3160 | GAUCUUAUAGGCAAAUAGA | 3440 |
| AD-75144 | A-150794 | AAGAAUUUAAAAGAUAAGUdTdT | 2881 | A-150795 | ACUUAUCUUUUAAAUUCUUdTdT | 3161 | AAGAAUUUAAAAGAUAAGU | 3441 |
| AD-75145 | A-150796 | GUAAGUCCUUAUUGAUUUdTdT | 2882 | A-150797 | AAAUCAAUAAGGAACUUACdTdT | 3162 | GUAAGUCCUUAUUGAUUU | 3442 |
| AD-75146 | A-150798 | UUUUGUGCACUCUGCUCUAdTdT | 2883 | A-150799 | UAGAGCAGAGUGCACAAAAdTdT | 3163 | UUUUGUGCACUCUGCUCUA | 3443 |
| AD-75147 | A-150800 | AAACAGAUAUUCAGCAAGUdTdT | 2884 | A-150801 | ACUUGCUGAAUAUCUGUUUdTdT | 3164 | AAACAGAUAUUCAGCAAGU | 3444 |
| AD-75148 | A-150802 | UCAGCAAGUGGAGAAAAUAdTdT | 2885 | A-150803 | UAUUUUCUCCACUUGCUGAdTdT | 3165 | UCAGCAAGUGGAGAAAAUA | 3445 |
| AD-75149 | A-150804 | AAGAACAAAGAGAAAAAUdTdT | 2886 | A-150805 | AUUUUUCUCUUUGUUCUUdTdT | 3166 | AAGAACAAAGAGAAAAAU | 3446 |

TABLE 20-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-75150 | A-150806 | AUACAUAGAUUUACCUGCAdTdT | 2887 | A-150807 | UGCAGGUAAAUCUAUGUAdTdT | 3167 | AUACAUAGAUUUACCUGCA | 3447 |
| AD-75151 | A-150808 | UUACCUGCAAAAAAUAGCUdTdT | 2888 | A-150809 | AGCUAUUUUUGCAGGUAAdTdT | 3168 | UUACCUGCAAAAAAUAGCU | 3448 |
| AD-75152 | A-150810 | UUUAUGAAGAGACAUUCUCdTdT | 2889 | A-150811 | UGAGAAUGUCUUCUAUAAdTdT | 3169 | UUUAUGAAGAGACAUUCUC | 3449 |
| AD-75153 | A-150812 | AGACAUCUCAAAGAGCAGUdTdT | 2890 | A-150813 | ACUGCUCUUUGAGAUGUCUdTdT | 3170 | AGACAUCUCAAAGAGCAGU | 3450 |
| AD-75154 | A-150814 | UAUGAGAUGGGGGUUAUCUdTdT | 2891 | A-150815 | AGAUAACCCCAUCUCAUAdTdT | 3171 | UAUGAGAUGGGGGUUAUCU | 3451 |
| AD-75155 | A-150816 | CUACUGAUAAAGAAAGAAUdTdT | 2892 | A-150817 | AUUCUUUCUUUAUCAGUAGdTdT | 3172 | CUACUGAUAAAGAAAGAAU | 3452 |
| AD-75156 | A-150818 | AAAGAAUUUAUGAGAAAUUdTdT | 2893 | A-150819 | AAUUUCUCAUAAAUUCUUUdTdT | 3173 | AAAGAAUUUAUGAGAAAUU | 3453 |
| AD-75157 | A-150820 | UAACAAUCUGUGAAGAUUUdTdT | 2894 | A-150821 | AAAUCUUCACAGAUUGUUAdTdT | 3174 | UAACAAUCUGUGAAGAUUU | 3454 |
| AD-75158 | A-150822 | UUUACUUUAUACAGUCUUdTdT | 2895 | A-150823 | AAGACUGUAUAAAGUAAAdTdT | 3175 | UUUACUUUAUACAGUCUU | 3455 |
| AD-75159 | A-150824 | UUUAUGAAUUCUUUAAUGUdTdT | 2896 | A-150825 | ACAUUAAAGAAUUCAUAAAdTdT | 3176 | UUUAUGAAUUCUUUAAUGU | 3456 |
| AD-75160 | A-150826 | UUAAUGUUCAAAAAUGACUUdTdT | 2897 | A-150827 | AAGUCAUUUUGAACAUUAAdTdT | 3177 | UUAAUGUUCAAAAAUGACUU | 3457 |
| AD-75161 | A-150828 | UUCUUCUUUUUUUUAUAUCAdTdT | 2898 | A-150829 | UGAUAUAAAAAAAGAAGAAdTdT | 3178 | UUCUUCUUUUUUUUAUAUCA | 3458 |
| AD-75162 | A-150830 | AGAAUGAGGAAUAAUAAGUdTdT | 2899 | A-150831 | ACUUAUUAUUCCUCAUUCUdTdT | 3179 | AGAAUGAGGAAUAAUAAGU | 3459 |
| AD-75163 | A-150832 | UUAAACCCACAUCUAGACUCUdTdT | 2900 | A-150833 | AGAGUCUAGUGUGGGUUUAAdTdT | 3180 | UUAAACCCACAUCUAGACUCU | 3460 |
| AD-75164 | A-150834 | CUUUAAAACUAUAGGCUAGdTdT | 2901 | A-150835 | UUAGCCUAUAGUUUUAAAGdTdT | 3181 | CUUUAAAACUAUAGGCUAG | 3461 |
| AD-75165 | A-150836 | AGAUAGAAAUGUAUGUUUGdTdT | 2902 | A-150837 | UAAACAUACAUUUCUAUCUdTdT | 3182 | AGAUAGAAAUGUAUGUUUG | 3462 |
| AD-75166 | A-150838 | UUUGACUUGUUGAAGCUAUdTdT | 2903 | A-150839 | AUAGCUUCAACAAGUCAAAdTdT | 3183 | UUUGACUUGUUGAAGCUAU | 3463 |
| AD-75167 | A-150840 | UUUUUAAUCUUAAAAGAUUdTdT | 2904 | A-150841 | AAUCUUUUAAGAUUAAAAAdTdT | 3184 | UUUUUAAUCUUAAAAGAUU | 3464 |
| AD-75168 | A-150842 | UUGUGCUAAUUUAUUAGAAdTdT | 2905 | A-150843 | UUCUAAUAAAUUAGCACAAdTdT | 3185 | UUGUGCUAAUUUAUUAGAG | 3465 |
| AD-75169 | A-150844 | UUAUUAGAGCAGAACCUGUdTdT | 2906 | A-150845 | ACAGGUUCUGCUCUAAUAAdTdT | 3186 | UUAUUAGAGCAGAACCUGU | 3466 |
| AD-75170 | A-150846 | GUUUGGCUCUCCUUCAGAAGdTdT | 2907 | A-150847 | UUUCUGAGGAGAGCCAAACdTdT | 3187 | GUUUGGCUCUCCUUCAGAAG | 3467 |
| AD-75171 | A-150848 | CAAUUUUCAAAAGAUAAAdTdT | 2908 | A-150849 | UUAUCUUUUGAAAAUAUUGdTdT | 3188 | CAAUAUUUUCAAAAGAUAA | 3468 |
| AD-75172 | A-150850 | UCAAAAGAUAAAUCUGAUUdTdT | 2909 | A-150851 | AAUCAGAUUUAUCUUUUGAdTdT | 3189 | UCAAAAGAUAAAUCUGAUU | 3469 |
| AD-75173 | A-150852 | UUAUGCAAUGGCAUCAUUUdTdT | 2910 | A-150853 | AAAUGAUGCCAUUGCAUAAdTdT | 3190 | UUAUGCAAUGGCAUCAUUU | 3470 |

TABLE 20-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-75174 | A-150854 | UGCAAUGGCAUCAUUUAUUdTdT | 2911 | A-150855 | AAUAAAUGAUGCCAUUGCAdTdT | 3191 | UGCAAUGGCAUCAUUUAUU | 3471 |
| AD-75175 | A-150856 | UUUAAAACAGAAGAAUUGUdTdT | 2912 | A-150857 | ACAAUUCUUCUGUUUUAAAdTdT | 3192 | UUUAAAACAGAAGAAUUGU | 3472 |
| AD-75176 | A-150858 | AACAACAAAAGGAAAAUGUdTdT | 2913 | A-150859 | ACAUUUUCCUUUUGUUGUUdTdT | 3193 | AACAACAAAAGGAAAAUGU | 3473 |
| AD-75177 | A-150860 | UUAAUCCUGUAGUACAUAUdTdT | 2914 | A-150861 | AUAUGUACUACAGGAUUAAdTdT | 3194 | UUAAUCCUGUAGUACAUAU | 3474 |
| AD-75178 | A-150862 | UUUAAUAUUUUAUAAGACAdTdT | 2915 | A-150863 | UGUCUUAUAAAAUAUUAAAdTdT | 3195 | UUUAAUAUUUUAUAAGACC | 3475 |
| AD-75179 | A-150864 | CCUUCCGUUAGUAUUAAdTdT | 2916 | A-150865 | UUUAAUACCUAACAGGAAGdTdT | 3196 | CCUUCCGUUAGUAUUAG | 3476 |
| AD-75180 | A-150866 | UUAGGUAUAGAAAGUGAUdTdT | 2917 | A-150867 | AUCACUUUCUAUACCUAAdTdT | 3197 | UUAGGUAUAGAAAGUGAU | 3477 |
| AD-75181 | A-150868 | AUACAUAGAUAUCUUUUUdTdT | 2918 | A-150869 | AAAAAAGAUAUCUAUGUAUdTdT | 3198 | AUACAUAGAUAUCUUUUU | 3478 |
| AD-75182 | A-150870 | UUUUGUGUAAUUCUAUUdTdT | 2919 | A-150871 | AAUAGAAUUACACAAAAAdTdT | 3199 | UUUUGUGUAAUUCUAUU | 3479 |
| AD-75183 | A-150872 | UAAAAAGAGAGAAGACUdTdT | 2920 | A-150873 | AGUCUUCUCUCUUUUUUAdTdT | 3200 | UAAAAAGAGAGAAGACU | 3480 |
| AD-75184 | A-150874 | CUGUCAGAAGCUUUAAGUGdTdT | 2921 | A-150875 | UACUUAAAGCUUCUGACAGdTdT | 3201 | CUGUCAGAAGCUUUAAGUG | 3481 |
| AD-75185 | A-150876 | UAUGGUACAGGAUAAAGAUdTdT | 2922 | A-150877 | AUCUUUAUCCUGUACCAUAdTdT | 3202 | UAUGGUACAGGAUAAAGAU | 3482 |
| AD-75186 | A-150878 | UUAAAUACCAAUUCCUAUdTdT | 2923 | A-150879 | AUAGGAAUUGGUAUUUAAdTdT | 3203 | UUAAAUACCAAUUCCUAU | 3483 |
| AD-75187 | A-150880 | UUGUUUUAAAGAAACCUdTdT | 2924 | A-150881 | AGGUUUCUUUAAAACAAdTdT | 3204 | UUGUUUUAAAGAAACCU | 3484 |
| AD-75188 | A-150882 | CUCUCACAGAUAAGACAGAdTdT | 2925 | A-150883 | UCUGUCUUAUCUGUGAGAGdTdT | 3205 | CUCUCACAGAUAAGACAGA | 3485 |
| AD-75189 | A-150884 | CAGAAUUUAUAGAGGGCUdTdT | 2926 | A-150885 | AGCCCUCUAUAAAUUCUGdTdT | 3206 | CAGAAUUUAUAGAGGGCU | 3486 |
| AD-75190 | A-150886 | UCUAGAAUUAAAGGAACCUdTdT | 2927 | A-150887 | AGGUUCCUUUAAUUCUAGAdTdT | 3207 | UCUAGAAUUAAAGGAACCU | 3487 |
| AD-75191 | A-150888 | CUCACUGAAAACAUAUAUUdTdT | 2928 | A-150889 | AAUAUAUGUUUUCAGUGAGdTdT | 3208 | CUCACUGAAAACAUAUAUU | 3488 |
| AD-75192 | A-150890 | AAACAUAUUUCACGUGUdTdT | 2929 | A-150891 | ACACGUGAAAUAUGUUUdTdT | 3209 | AAACAUAUUUCACGUGU | 3489 |
| AD-75193 | A-150892 | GUUCCCUCUUUUUUUUUdTdT | 2930 | A-150893 | AAAAAAAAAAGAGGGAACdTdT | 3210 | GUUCCCUCUUUUUUUUU | 3490 |
| AD-75194 | A-150894 | UUAAGCGAUUCUCCUGCCUdTdT | 2931 | A-150895 | AGGCAGGAGAAUCGCUUAAdTdT | 3211 | UUAAGCGAUUCUCCUGCCU | 3491 |
| AD-75195 | A-150896 | CGGCUAAUUUUUUGGAUUdTdT | 2932 | A-150897 | AAAUCCAAAAAAUUAGCCGdTdT | 3212 | CGGCUAAUUUUUUGGAUUU | 3492 |
| AD-75196 | A-150898 | UUUAUAGAGACGGGGUUUdTdT | 2933 | A-150899 | AAACCCCGUCUCUAUAAAdTdT | 3213 | UUUAUAGAGACGGGGUUU | 3493 |

TABLE 20-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-75197 | A-150900 | UUUACCAUGUUGGCCAGGUdTdT | 2934 | A-150901 | ACCUGGCCAACAUGGUAAAdTdT | 3214 | UUUACCAUGUUGGCCAGU | 3494 |
| AD-75198 | A-150902 | UUGCUGGGAUUACAGGCAUdTdT | 2935 | A-150903 | AUGCCUGUAAUCCCAGCAAdTdT | 3215 | UUGCUGGGAUUACAGGCAU | 3495 |
| AD-75199 | A-150904 | UUAAACAUGAUCCUUCUCUdTdT | 2936 | A-150905 | AGAGAAGGAUCAUGUUUAAdTdT | 3216 | UUAAACAUGAUCCUUCUCU | 3496 |
| AD-75200 | A-150906 | GGGGUCUUUCAAGGGGAAAdTdT | 2937 | A-150907 | UUUCCCCUUGAAAGACCCCdTdT | 3217 | GGGGUCUUUCAAGGGGAAA | 3497 |
| AD-75201 | A-150908 | AAAAAUCCAAGCUUUUUUAdTdT | 2938 | A-150909 | UAAAAAGCUUGGAUUUUUdTdT | 3218 | AAAAAUCCAAGCUUUUUUA | 3498 |
| AD-75202 | A-150910 | AAAGUAAAAAAAAAAAGdTdT | 2939 | A-150911 | CUUUUUUUUUUUACUUUdTdT | 3219 | AAAGUAAAAAAAAAAAAG | 3499 |
| AD-75203 | A-150912 | AGAGAGGACACAAAACCAAdTdT | 2940 | A-150913 | UUGGUUUUGUGUCCUCUCUdTdT | 3220 | AGAGAGGACACAAAACCAA | 3500 |
| AD-75204 | A-150914 | UUAAGAUGGAGACAGAGUUdTdT | 2941 | A-150915 | AACUCUGUCUCCAUCUUAAdTdT | 3221 | UUAAGAUGGAGACAGAGUU | 3501 |
| AD-75205 | A-150916 | UUUCUCCUAAUAACCGGAAdTdT | 2942 | A-150917 | UUCCGGUUAUUAGGAGAAAdTdT | 3222 | UUUCUCCUAAUAACCGGAG | 3502 |
| AD-75206 | A-150918 | GCUGAAUUACCUUUCACUUdTdT | 2943 | A-150919 | AAGUGAAAGGUAAUUCAGCdTdT | 3223 | GCUGAAUUACCUUUCACUU | 3503 |
| AD-75207 | A-150920 | UCCAAAAACAUGACCUUCAdTdT | 2944 | A-150921 | UGAAGGUCAUGUUUUUGAAdTdT | 3224 | UCCAAAAACAUGACCUUCC | 3504 |
| AD-75208 | A-150922 | CAAUCCUUAGAAUCUGCCUdTdT | 2945 | A-150923 | AGGCAGAUUCUAAGGAUUGdTdT | 3225 | CAAUCCUUAGAAUCUGCCU | 3505 |
| AD-75209 | A-150924 | UUUUAUAUUACUGAGGCCUdTdT | 2946 | A-150925 | AGGCCUCAGUAAUAUAAAAdTdT | 3226 | UUUUAUAUUACUGAGGCCU | 3506 |
| AD-75210 | A-150926 | AAAAGUAAACAUUACAUCAUdTdT | 2947 | A-150927 | AUGAGUAAUGUUUACUUUUdTdT | 3227 | AAAAGUAAACAUUACUCAU | 3507 |
| AD-75211 | A-150928 | UUUAUUUGCCCAAAAUGAdTdT | 2948 | A-150929 | UCAUUUUGGGCAAAAUAAAdTdT | 3228 | UUUAUUUGCCCAAAAUGC | 3508 |
| AD-75212 | A-150930 | CACUGAUGUAAAGUAGGAAdTdT | 2949 | A-150931 | UUCCUACUUUACAUCAGUGdTdT | 3229 | CACUGAUGUAAAGUAGGAA | 3509 |
| AD-75213 | A-150932 | AAAAUAAAAACAGAGCUCUdTdT | 2950 | A-150933 | AGAGCUCUGUUUUUAUUUUdTdT | 3230 | AAAAUAAAAACAGAGCUCU | 3510 |
| AD-75214 | A-150934 | CUAAAUCCCUUUCAAGCAdTdT | 2951 | A-150935 | UGCUUGAAAGGGAUUUUAGdTdT | 3231 | CUAAAUCCCUUUCAAGCC | 3511 |
| AD-75215 | A-150936 | UUGACCCCACUCACCAACUdTdT | 2952 | A-150937 | AGUUGGUGAGUGGGGUCAAdTdT | 3232 | UUGACCCCACUCACCAACU | 3512 |
| AD-75216 | A-150938 | UUAUCUUGUACCCGCUGCUdTdT | 2953 | A-150939 | AGCAGCGGGUACAAGAUAAdTdT | 3233 | UUAUCUUGUACCCGCUGCU | 3513 |
| AD-75217 | A-150940 | CUGAAACCUCAAGCAGUCUdTdT | 2954 | A-150941 | AGACAGCUUGAGGUUUCAGdTdT | 3234 | CUGAAACCUCAAGCAGUCU | 3514 |
| AD-75218 | A-150942 | GUAUCAUGAAAAUGUCUAUdTdT | 2955 | A-150943 | AUAGACAUUUUCAUGAUACdTdT | 3235 | GUAUCAUGAAAAUGUCUAU | 3515 |
| AD-75219 | A-150944 | UCCAAAAUAUCAAACCUUdTdT | 2956 | A-150945 | AAGGUUUUGAUAUUUUGAAdTdT | 3236 | UCCAAAAUAUCAAACCUU | 3516 |
| AD-75220 | A-150946 | UUUCAAAUAUCACGCAGCUdTdT | 2957 | A-150947 | AGCUGCGUGAUAUUUGAAAdTdT | 3237 | UUUCAAAUAUCACGCAGCU | 3517 |

TABLE 20-continued

Modified Sense and Antisense Strand Sequences of IGF-1 dsRNAs

| Duplex Name | Sense Oligo Name | Sense sequence | SEQ ID NO | Antisense Oligo Name | Antisense sequence | SEQ ID NO | mRNA target sequence | SEQ ID NO |
|---|---|---|---|---|---|---|---|---|
| AD-75221 | A-150948 | CUUAUAUUCAGUUUACAUAdTdT | 2958 | A-150949 | UAUGUAAACUGAAUAUAAGdTdT | 3238 | CUUAUAUUCAGUUUACAUA | 3518 |
| AD-75222 | A-150950 | UUACAUAAAGGCCCCAAAUdTdT | 2959 | A-150951 | AUUUGGGGCCUUUAUGUAAdTdT | 3239 | UUACAUAAAGGCCCCAAAU | 3519 |
| AD-75223 | A-150952 | AUACCAUGUCAGAUCUUUUdTdT | 2960 | A-150953 | AAAAGAUCUGACAUGGUAUdTdT | 3240 | AUACCAUGUCAGAUCUUUU | 3520 |
| AD-75224 | A-150954 | AAAAGAGUAAUGAACUAUdTdT | 2961 | A-150955 | AUAGUUCAUUACUCUUUUdTdT | 3241 | AAAAGAGUAAUGAACUAU | 3521 |
| AD-75225 | A-150956 | AUGAGAAUUGGGAUUACAUdTdT | 2962 | A-150957 | AUGUAAUCCCAAUUCUCAUdTdT | 3242 | AUGAGAAUUGGGAUUACAU | 3522 |
| AD-75226 | A-150958 | AUCAUGUAUUUGCCUCAdTdT | 2963 | A-150959 | AUGAGGCAAAAUACAUGAUdTdT | 3243 | AUCAUGUAUUUGCCUCAU | 3523 |
| AD-75227 | A-150960 | UUAUCACACUUAUAGGCCAdTdT | 2964 | A-150961 | UGGCCUAUAAGUGUGAUAAdTdT | 3244 | UUAUCACACUUAUAGGCCA | 3524 |
| AD-75228 | A-150962 | CAAGUGUGAUAAAAUAAACUdTdT | 2965 | A-150963 | AGUUUAUUUAUCACACUUGdTdT | 3245 | CAAGUGUGAUAAAAUAAACU | 3525 |
| AD-75229 | A-150964 | UUACAGACACUGAAUUAAUdTdT | 2966 | A-150965 | AUUAAUUCAGUGUCUGUAAdTdT | 3246 | UUACAGACACUGAAUUAAU | 3526 |
| AD-75230 | A-150966 | UUUGAAACCAGAAAAAUAAUdTdT | 2967 | A-150967 | AUUAUUUUCUGGUUUCAAAdTdT | 3247 | UUUGAAACCAGAAAAAUAAU | 3527 |
| AD-75231 | A-150968 | AUGACUGGCCAUUCGUUACdTdT | 2968 | A-150969 | UUAACGAAUGGCCAGUCAUdTdT | 3248 | AUGACUGGCCAUUCGUUAC | 3528 |
| AD-75232 | A-150970 | UAGUUGAAAAGCAUAUUUdTdT | 2969 | A-150971 | AAAUAUGCUUUUCAACUAAdTdT | 3249 | UAGUUGAAAAGCAUAUUU | 3529 |
| AD-75233 | A-150972 | UUUUAUUAAAUUAAUUCUdTdT | 2970 | A-150973 | AGAAUUAAUUUAAUAAAAAdTdT | 3250 | UUUUAUUAAAUUAAUUCU | 3530 |
| AD-75234 | A-150974 | CUGAAUGUAUUUGAAAUAdTdT | 2971 | A-150975 | UAAUUUCAAAAUACAAUCAGdTdT | 3251 | CUGAAUGUAUUUGAAAUA | 3531 |
| AD-75235 | A-150976 | UUUGAAAUAUAUUUCAUdTdT | 2972 | A-150977 | AUUGAAUAUAUUUCAAAdTdT | 3252 | UUUGAAAUAUAUUUCAU | 3532 |
| AD-75236 | A-150978 | UUAUGGCAGAGAAUAUCAdTdT | 2973 | A-150979 | UGAUAUUCCUCUGCCAUAAdTdT | 3253 | UUAUGGCAGAGAAUAUCA | 3533 |
| AD-75237 | A-150980 | UCUAAAAAUGUAACUAAUUdTdT | 2974 | A-150981 | AAUUAGUUACAUUUUUAGAdTdT | 3254 | UCUAAAAAUGUAACUAAUU | 3534 |
| AD-75238 | A-150982 | UUUACUGUUUAAUAAGCAUdTdT | 2975 | A-150983 | AUGCUUAUUAAACAGUAAdTdT | 3255 | UUUACUGUUUAAUAAGCAU | 3535 |
| AD-75239 | A-150984 | UGUCAUAUAAAAAUGGUAUdTdT | 2976 | A-150985 | AUACCAUUUUAUUAUGACAdTdT | 3256 | UGUCAUAUAAAAAUGGUAU | 3536 |
| AD-75240 | A-150986 | AUAUCUUUCUUUAGUAAUUdTdT | 2977 | A-150987 | AAUUACUAAAGAAAGAUAUdTdT | 3257 | AUAUCUUUCUUUAGUAAUU | 3537 |
| AD-75241 | A-150988 | UUAGUAAUUACAUUAAAAUdTdT | 2978 | A-150989 | AUUUUAAUGUAAUUACUAAdTdT | 3258 | UUAGUAAUUACAUUAAAAU | 3538 |
| AD-75242 | A-150990 | AUUAGUCAUGUUGAUUAAdTdT | 2979 | A-150991 | UUAAUCAAACAUGACUAAUdTdT | 3259 | AUUAGUCAUGUUGAUUAA | 3539 |

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (3539 sequences)

SEQ ID NO: 1 - DNA, 2168 bp, Homo sapiens
ggaaatccagagggcaggggtggccggcacagcagacgtaccctccctcgctgcctgcctgcagcctgccctgcatgcaggatggccctgaggaaaggaggcctggccctggcgctgctgctgctgtcctgggtggcactgggcccccgcagcctggagggagcagaccccggaacgccgggggaagccgagggcccagcgtgcccggccgcctgtgtctgcagctacgatgacgacgcggatgagctcagcgtcttctgcagctccaggaacctcacgcgcctgcctgatggagtcccgggcggcacccaagccctgtggctggacggcaacaacctctcgtccgtccccccggcagccttccagaacctctccagcctgggcttcctcaacctgcagggcggccagctgggcagcctggagccacaggcgctgctgggcctagagaacctgtgccacctgcacctggagcggaaccagctgcgcagcctggcactcggcacgtttgcacacacgcccgcgctggcctcgctcggcctcagcaacaaccgtctgagcaggctggaggacgggctcttcgagggcctcggcagcctctgggacctcaacctcggctggaatagcctggcggtgctccccgatgcggcgttccgcggcctgggcagcctgcgcgagctggtgctggcgggcaacaggctggcctacctgcagcccgcgctcttcagcggcctggccgagctccgggagctggacctgagcaggaacgcgctgcgggccatcaaggcaaacgtgttcgtgcagctgccccggctccagaaactctacctggaccgcaacctcatcgctgccgtggccccgggcgccttcctgggcctgaaggcgctgcgatggctggacctgtcccacaaccgcgtggctggcctcctggaggacacgttccccggtctgctgggcctgcgtgtgctgcggctgtcccacaacgccatcgccagcctgcggccccgcaccttcaaggacctgcacttcctggaggagctgcagctgggccacaaccgcatccggcagctggctgagcgcagctttgagggcctggggcagcttgaggtgctcacgctagaccacaaccagctccaggaggtcaaggcgggcgctttcctcggcctcaccaacgtggcggtcatgaacctctctgggaactgtctccggaaccttccggagcaggtgttccggggcctgggcaagctgcacagcctgcacctggagggcagctgcctgggacgcatccgcccgcacaccttcaccggcctctcggggctccgccgactcttcctcaaggacaacggcctcgtgggcattgaggagcagagcctgtgggggctggcggagctgctggagctcgacctgacctccaaccagctcacgcacctgccccaccgcctcttccagggcctgggcaagctggagtacctgctgctctcccgcaaccgcctggcagagctgccggcggacgccctgggccccctgcagcgggccttctggctggacgtctcgcacaaccgcctggaggcattgcccaacagcctcttggcaccactggggcggctgcgctacctcagcctcaggaacaactcactgcggaccttcacgccgcagcccccgggcctggagcgcctgtggctggagggtaacccctgggactgtggctgccctctcaaggcgctgcgggacttcgccctgcagaaccccagtgctgtgccccgcttcgtccaggccatctgtgagggggacgattgccagccgcccgcgtacacctacaacaacatcacctgtgccagcccgcccgaggtcgtggggctcgacctgcgggacctcagcgaggcccactttgctccctgctgaccaggtccccggactcaagccccggactcaggcccccacctggctcaccttgtgctggggacaggtcctcagtgtcctcaggggcctgcccagtgcacttgctggaagacgcaagggcctgatggggtggaaggcatggcggcccccccagctgtcatcaattaaaggcaaaggcaatcgaatctaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2 - DNA, 2168 bp, Homo sapiens
ttttttttttttttttttttttttttttttttttttttttttttttttttttttttttttttttttttttttttttttttttttagattcgattgcctttgcctttaattgatgacagctgggggggccgccatgccttccaccccatcaggcccttgcgtcttccagcaagtgcactgggcaggcccctgaggacactgaggacctgtccccagcacaaggtgagccaggtgggggcctgagtccggggcttgagtccggggacctggtcagcagggagcaaagtgggcctcgctgaggtcccgcaggtcgagccccacgacctcgggcgggctggcacaggtgatgttgttgtaggtgtacgcgggcggctggcaatcgtccccctcacagatggcctggacgaagcggggcacagcactggggttctgcagggcgaagtcccgcagcgccttgagagggcagccacagtcccaggggttaccctccagccacaggcgctccaggcccgggggctgcggcgtgaaggtccgcagtgagttgttcctgaggctgaggtagcgcagccgccccagtggtgccaagaggctgttgggcaatgcctccaggcggttgtgcgagacgtccagccagaaggcccgctgcagggggcccagggcgtccgccggcagctctgccaggcggttgcgggagagcagcaggtactccagcttgcccaggccctggaagaggcggtggggcaggtgcgtgagctggttggaggtcaggtcgagctccagcagctccgccagcccccacaggctctgctcctcaatgcccacgaggccgttgtccttgaggaagagtcggcggagccccgagaggccggtgaaggtgtgcgggcggatgcgtcccaggcagctgccctccaggtgcaggctgtgcagcttgcccaggccccggaacacctgctccggaaggttccggagacagttcccagagaggttcatgaccgccacgttggtgaggccgaggaaagcgcccgccttgacctcctggagctggttgtggtctagcgtgagcacctcaagctgccccaggccctcaaagctgcgctcagccagctgccggatgcggttgtggcccagctgcagctcctccaggaagtgcaggtccttgaaggtgcggggccgcaggctggcgatggcgttgtgggacagccgcagcacacgcaggcccagcagaccggggaacgtgtcctccaggaggccagccacgcggttgtgggacaggtccagccatcgcagcgccttcaggcccaggaaggcgcccggggccacggcagcgatgaggttgcggtccaggtagagtttctggagccggggcagctgcacgaacacgtttgccttgatggcccgcagcgcgttcctgctcaggtccagctcccggagctcggccaggccgctgaagagcgcgggctgcaggtaggccagcctgttgcccgccagcaccagctcgcgcaggctgcccaggccgcggaacgccgcatcggggagcaccgccaggctattccagccgaggttgaggtcccagaggctgccgaggccctcgaagagcccgtcctccagcctgctcagacggttgttgctgaggccgagcgaggccagcgcgggcgtgtgtgcaaacgtgccgagtgccaggctgcgcagctggttccgctccaggtgcaggtggcacaggttctctaggcccagcagcgcctgtggctccaggctgcccagctggccgccctgcaggttgaggaagcccaggctggagaggttctggaaggctgccggggggacggacgagaggttgttgccgtccagccacagggcttgggtgccgcccgggactccatcaggcaggcgcgtgaggttcctggagctgcagaagacgctgagctcatccgcgtcgtcatcgtagctgcagacacaggcggccgggcacgctgggccctcggcttcccccggcgttccggggtctgctccctccaggctgcgggggcccagtgccacccaggacagcagcagcagcgccagggccaggcctcctttcctcagggccatcctgcatgcagggcaggctgcaggcaggcagcgagggagggtacgtctgctgtgccggccacccctgccctctggatttcc

SEQ ID NO: 3 - DNA, 2111 bp, Mus musculus
gctcactgcctgcctgcggccagctctgtacaaggaacaatggctctgagaacaggaagcccagccctggtggtgcttctggctttctgggtggcactgggcccctgttacctgcaggggacagatcctggagcatcagcagatgccgagggcccccagtgccctgtcacctgtacctgcagctatgatgactacacagatgagctcagcgtcttttgcagttcaaggaacctcactcagctgcccgatagcatcccagtcagcaccagggctctgtggcttgacggaaacaacctgtcctccatcccctcagcggccttccagaacctgtccagcctagacttcctcaacctgcagggcagctggctgaggagcctggagccacaggcactgctgggcctgcagaatctctaccatctgcacctggaacggaacctgctccggagcctagctgcaggcttgttcagacacacaccaagtctggcttcactcagtttgggcaacaacctcctgggccggctggaagaagggctgttccggggcctcagtcacctttgggacctcaacctgggttggaacagcctagtggtcctgcctgacacggtgttccagggcctgggcaacctccatgagctggtgcttgctggcaacaaactgacttacctgcagcctgcgctcttgtgtggcttgggcgagctgcgggagctggacctgagcaggaacgctctccgcagcgtcaaagctaatgtctttatacatctgccccggctgcagaagctctacctggaccgcaacctcatcacagctgtggccccccgtgccttcctgggcatgaaggcactgcgttggctggacctgtcacacaaccgtgtggctggcctcctggaggacaccttccctggcctgctgggtctgcatgtcctgcgcctggcacacaacgccatcactagcttgcggccgcgtactttcaaagatctacacttcctggaggaactgcagctcggccacaatcgtatcaggcagttaggtgagaagacgtttgagggcctggggcagctggaggtactgacgctcaatgacaatcagatccatgaggtcaaggtgggcgccttctttggcctcttcaacgtggctgttatgaatctctccggcaactgtctgaggagcctccccgagcatgtgttccaagggctgggcaggctgcacagcttgcacctggagcacagctgcctgggccgcatccgcctgcacactttcgccggcctctcagggctgcgcaggctcttcctccgggacaacagcatctccagcatcgaagaacagagcctggcagggctctcagagctcctggaactcgatcttaccgccaaccagctcacgcatctgccccgccagcttttccagggccttggccagctggaatatctgcttctgtccaacaaccaactgacaatgctctctgaggatgtcctgggccctctgcagcgggccttctggctggacctctcacacaaccgcctcgagaccccggctgaaggccttttctcatctctggggcggcttcgctacctcaacctcaggaataactccttgcagacttttgtgccgcagcctggcctggagcgcctgtggctcgatgccaacccctgggactgcagttgtcccctcaaggcgcttcgtgactttgccctacagaaccctggtgttgtcccccgctttgttcagactgtctgtgagggagatgactgccagccggtgtacacttacaacaacatcacttgtgctggccccgccaacgtctcaggcctcgaccttcgagacatcagtgaaacactctttgtgcactgctgaccctgctacttactggcctggtctggctgaacactgccttatggccaggatagtgtttcactgttacagaataagctggctctggaatacttacccatctcaaggggataggtcatggctgctcacttcctggatgcagggcagtaccggaagcgatgtggcctaaatagggtgggcacaggccaagtgcccgagggcccaaaggaggggaggtgctcagcagcacaccctgctggcaacaattaaagcaaatctgaagc

SEQ ID NO: 4 - DNA, 2111 bp, Mus musculus
gcttcagatttgctttaattgttgccagcagggtgtgctgctgagcacctcccctcctttgggccctcgggcacttggcctgtgcccaccctatttaggccacatcgcttccggtactgccctgcatccaggaagtgagcagccatgacctatccccttgagatgggtaagtattccagagccagcttattctgtaacagtgaaacactatcctggccataaggcagtgttcagccagaccaggccagtaagtagcagggtcagcagtgcacaaagagtgtttcactgatgtctcgaaggtcgaggcctgagacgttggcggggccagcacaagtgatgttgttgtaagtgtacaccggctggcagtcatctccctcacagacagtctgaacaaagcgggggacaacaccagggttctgtagggcaaagtcacgaagcgccttgaggggacaactgcagtcccaggggttggcatcgagccacaggcgctccaggccaggctgcggcacaaaagtctgcaaggagttattcctgaggttgaggtagcgaagccgccccagagatgagaaaaggccttcagccggggtctcgaggcggttgtgtgagaggtccagccagaaggcccgctgcagagggcccaggacatcctcagagagcattgtcagttggttgttggacagaagcagatattccagctggccaaggccctggaaaagctggcggggcagatgcgtgagctggttggcggtaagatcgagttccaggagctctgagagccctgccaggctctgttcttcgatgctggagatgctgttgtcccggaggaagagcctgcgcagccctgagaggccggcgaaagtgtgcaggcggatgcggcccaggcagctgtgctccaggtgcaagctgtgcagcctgcccagcccttggaacacatgctcggggaggctcctcagacagttgccggagagattcataacagccacgttgaagaggccaaagaaggcgcccaccttgacctcatggatctgattgtcattgagcgtcagtacctccagctgccccaggccctcaaacgtcttctcacctaactgcctgatacgattgtggccgagctgcagttcctccaggaagtgtagatctttgaaagtacgcggccgcaagctagtgatggcgttgtgtgccaggcgcaggacatgcagacccagcaggccagggaaggtgtcctccaggaggccagccacacggttgtgtgacaggtccagccaacgcagtgccttcatgcccaggaaggcacggggggccacagctgtgatgaggttgcggtccaggtagagcttctgcagccggggcagatgtataaagacattagctttgacgctgcggagagcgttcctgctcaggtccagctcccgcagctcgcccaagccacacaagagcgcaggctgcaggtaagtcagtttgttgccagcaagcaccagctcatggaggttgcccaggccctggaacaccgtgtcaggcaggaccactaggctgttccaacccaggttgaggtcccaaaggtgactgaggccccggaacagcccttcttccagccggcccaggaggttgttgcccaaactgagtgaagccagacttggtgtgtgtctgaacaagcctgcagctaggctccggagcaggttccgttccaggtgcagatggtagagattctgcaggcccagcagtgcctgtggctccaggctcctcagccagctgccctgcaggttgaggaagtctaggctggacaggttctggaaggccgctgaggggatggaggacaggttgtttccgtcaagccacagagccctggtgctgactgggatgctatcgggcagctgagtgaggttccttgaactgcaaaagacgctgagctcatctgtgtagtcatcatagctgcaggtacaggtgacagggcactgggggccctcggcatctgctgatgctccaggatctgtcccctgcaggtaacaggggcccagtgccacccagaaagccagaagcaccaccagggctgggcttcctgttctcagagccattgttccttgtacagagctggccgcaggcaggcagtgagc

SEQ ID NO: 5 - DNA, 2190 bp, Rattus norvegicus
gctgccagctacaggcagtggggaaatccacagggcagcagctgtattgtagacggcccttgctcactgcctgcctgcagccagctctgtacaaggaacaatggccctgaggacaggaggcccagccctggtggtgcttctggctttctgggtggcactgggcccctgtcacctgcaggggacagatcccggagcgtcggcagatgccgagggcccccagtgccccgtcgcctgtacctgcagccatgatgactacacagatgagctcagcgtcttttgcagttcaaagaacctcacacatctgcctgatgacatcccagtcagcaccagagccctgtggcttgatggcaacaacctctcttctatcccctcagcggccttccagaacctgtccagcctggactttctcaacctgcagggcagctggctgaggagcctggagccacaggcactgctggggctgcagaacctctactatctgcacctggaacggaaccggctccggaacctcgccgtgggcttgttcacacacacaccgagtctggcttcactcagcctgagcagcaacctcttgggccggctggaggaagggctgttccagggcctcagtcacctttgggacctcaacctgggttggaacagtctagtggtcctgcctgacacagtgttccagggactgggcaacctccacgagctggtgctggctggcaacaaactgacttacctgcagcctgcgctcttctgtggcttgggcgagctgcgggagctggatctgagcaggaacgcactccgaagcgtcaaagctaacgtctttgtacatttgcccaggctgcagaagctgtacctggaccggaacctcattacagccgtggcccctggtgcctttctgggcatgaaggccctgcgttggctggacctgtcgcacaaccgcgtggctggcctcatggaggacaccttcccaggcctgctgggcctgcacgtcctgcgcctggcacacaatgcgatcgctagcttgcggccgcgcactttcaaagacctgcacttcctggaggaactgcagctgggccacaatcgaatcaggcagctcggggagaggacattcgagggcctggggcagctggaggtgctgacgctcaatgacaaccagatcactgaggtcagggtgggcgccttctctggccttttcaatgtggcggttatgaatctctccggcaactgtctgaggagcctcccggagcgggtgtttcagggtctggacaaactgcacagcctgcacctagagcacagctgcctgggtcacgtccgcctgcacacttttgctggcctctcagggctgcgcaggctcttcctcagggacaacagcatctccagcatcgaagaacagagcctggcagggctttcggagctcctggaactggatcttactaccaaccgcctcacacatctgccccgccagctcttccagggcctcggccacctggagtacctgcttctctcctacaaccaactgacgactttatccgcggaggtcctgggccctctgcagcgggccttctggttggatatctcacacaaccacctggagacgctggccgaaggccttttctcatctctggggcgcgttcgctacctcagcctcaggaataactccttgcagaccttttcaccacagcccggcctggagcgcctgtggcttgatgccaacccctgggactgcagctgtcccctcaaggcgcttcgagactttgccctgcagaaccctggtgttgtcccccgctttgttcagactgtctgtgagggggacgactgccagccggtgtacacctacaacaatatcacttgcgctggccccgccaacgtctcgggcctcgacctaagagacgttagtgaaacacattttgtgcactgctgacactggctacttactggcccggtctggccgaacactgtctcatggccaggacggtgtctcattgttaacagaataagctggctctcaaattcctacccatctctaggggacaggtcctggctgctcacttcctggaagcaggctgtactggaagctatgtggcctagaaagggtgggctcaggccaagtgtccaagggcccaaaggagggaggtgctcgctgaatttaagcatattagtcagcggaggaaaagaaactaaccaggattccctcagtaa

SEQ ID NO: 6 - DNA, 2190 bp, Rattus norvegicus
ttactgagggaatcctggttagtttcttttcctccgctgactaatatgcttaaattcagcgagcacctccctcctttgggcccttggacacttggcctgagcccaccctttctaggccacatagcttccagtacagcctgcttccaggaagtgagcagccaggacctgtcccctagagatgggtaggaatttgagagccagcttattctgttaacaatgagacaccgtcctggccatgagacagtgttcggccagaccgggccagtaagtagccagtgtcagcagtgcacaaaatgtgtttcactaacgtctcttaggtcgaggcccgagacgttggcggggccagcgcaagtgatattgttgtaggtgtacaccggctggcagtcgtccccctcacagacagtctgaacaaagcgggggacaacaccagggttctgcagggcaaagtctcgaagcgccttgaggggacagctgcagtcccaggggttggcatcaagccacaggcgctccaggccgggctgtggtgaaaaggtctgcaaggagttattcctgaggctgaggtagcgaacgcgccccagagatgagaaaaggccttcggccagcgtctccaggtggttgtgtgagatatccaaccagaaggcccgctgcagagggcccaggacctccgcggataaagtcgtcagttggttgtaggagagaagcaggtactccaggtggccgaggccctggaagagctggcggggcagatgtgtgaggcggttggtagtaagatccagttccaggagctccgaaagccctgccaggctctgttcttcgatgctggagatgctgttgtccctgaggaagagcctgcgcagccctgagaggccagcaaaagtgtgcaggcggacgtgacccaggcagctgtgctctaggtgcaggctgtgcagtttgtccagaccctgaaacacccgctccgggaggctcctcagacagttgccggagagattcataaccgccacattgaaaaggccagagaaggcgcccaccctgacctcagtgatctggttgtcattgagcgtcagcacctccagctgccccaggccctcgaatgtcctctccccgagctgcctgattcgattgtggcccagctgcagttcctccaggaagtgcaggtctttgaaagtgcgcggccgcaagctagcgatcgcattgtgtgccaggcgcaggacgtgcaggcccagcaggcctgggaaggtgtcctccatgaggccagccacgcggttgtgcgacaggtccagccaacgcagggccttcatgcccagaaaggcaccaggggccacggctgtaatgaggttccggtccaggtacagcttctgcagcctgggcaaatgtacaaagacgttagctttgacgcttcggagtgcgttcctgctcagatccagctcccgcagctcgcccaagccacagaagagcgcaggctgcaggtaagtcagtttgttgccagccagcaccagctcgtggaggttgcccagtccctggaacactgtgtcaggcaggaccactagactgttccaacccaggttgaggtcccaaaggtgactgaggccctggaacagcccttcctccagccggcccaagaggttgctgctcaggctgagtgaagccagactcggtgtgtgtgtgaacaagcccacggcgaggttccggagccggttccgttccaggtgcagatagtagaggttctgcagccccagcagtgcctgtggctccaggctcctcagccagctgccctgcaggttgagaaagtccaggctggacaggttctggaaggccgctgaggggatagaagagaggttgttgccatcaagccacagggctctggtgctgactgggatgtcatcaggcagatgtgtgaggttctttgaactgcaaaagacgctgagctcatctgtgtagtcatcatggctgcaggtacaggcgacggggcactgggggccctcggcatctgccgacgctccgggatctgtcccctgcaggtgacaggggcccagtgccacccagaaagccagaagcaccaccagggctgggcctcctgtcctcagggccattgttccttgtacagagctggctgcaggcaggcagtgagcaagggccgtctacaatacagctgctgccctgtggatttccccactgcctgtagctggcagc

SEQ ID NO: 7 - DNA, 2386 bp, Macaca fascicularis
ccggagccgcggacggggtagggcctggagagctgcggtctcctccagccccggctctgcctccacctgcgcccctcccggccgcttccctgaacgctttcccactgccgagggactggtgggcaggccccgctgacagccagaggaggggccagcagggacctggagaggaggggctgcagcggctcaggccctggtggagacagcgactgactgggaagtggtctgagcaggtggaggggagcgaggggccgctggaggcaggtggagacggagcccaggggtggcctcggacatggctgggcacacattcccgtggcctctctgcacacaagcggtgactgtggggcggccaggccctcaccagagccttggggcacagcaaggggcaggaggcctggccttggcgctgctgctgctgtcctgggtggcactcggcccccgcagcctggagggagcagagcccggaacgccgggggaagccgagggcccagcatgcccggccacctgtgcctgcagctacgatgaggaggcgaatgagctcagcgtcttctgcagctccaggaacctcacgcgcctgcctgacgggatcccgggcggcacccaagccctgtggttggacagcaacaacctctcgtccatccccccggcggctttccggaacctctccagcctggccttcctcaacttgcagggcggccagctgggcagcctggagccgcaggcactgctgggcctggagaacctgtgccacctgcacttggagcggaaccagctgcgcagcctggcggtcggcacctttgcgcacacacccgcgctggcctcgctgggcctcagcaacaaccgcctgagcaggctggaggacgggctctttgagggcctcggcaacctctgggacctcaaccttggctggaatagcctggccgtgctccccgatgcggcgttccgtggtctgggcggcctgcgcgagctggtgctggcgggcaacaggcttgcctacctgcagcccgcactcttcagcggcctggccgagctccgggagctggacctgagcaggaacgcgctgcgggccatcaaggccaacgtgttcgcgcagctgccccggctccagaagctctacctggaccgcaacctcatcgctgccgtggccccgggcgccttcctgggcctgaaggcactgcgatggctggacctgtcccacaaccgcgtggctggcctcctggaggacacgttccccggcctgctgggcctgcgcgtgctgcggctgtcccacaacgccatcgccagcctgcggccccgcaccttcgaggacctgcactttctggaggagctgcagctgggccacaaccgcatccggcagctggccgagcgcagctttgagggcctggggcaactcgaggtgctcacgctggaccacaaccagctccaggaggtcaaggtgggcgccttcctcggcctcaccaacgtggcggtcatgaacctctctgggaactgtctccggaaccttccggagcaggtgttccggggcctgggcaagctgcacagcctgcacctggagggcagctgcctgggccgcatccgcccacacaccttcgccggcctctcggggctccgccgcctcttcctcaaggacaacggcctcgtgggcattgaggagcagagcctgtgggggctggcggagctgctggagctcgacctgacctccaaccagctcacgcacctgccccaccagctcttccagggcctgggcaagctggagtacctgctgctctcccacaaccgcctggcggagctgccggcggatgccctgggccccctgcagcgggccttctggctggacgtctcgcacaaccgcctggaggcgttgcccggcagcctcttggcaccgctggggcggctgcgttacctcaacctcaggaacaactcactgcggaccttcacgccgcagccccctggcctggagcgcctgtggctggagggcaacccctgggactgcagctgccccctcaaggcgctatgggactttgccctgcagaaccccagtgccgtgccccgcttcgtccaggccatctgtgagggggacgactgccaaccccccgtgtacacctacaacaacatcacctgcaccagcccgcccgaggtcgcggggctcgacctgcgggacctcggcgaggcccacttcgctccctgctgaccagggccccggactcgggcccccgcctggctcaccctgtgctggggacaggtcctcagtgtcctcaggggcctggcaggcatgcggccccacgccgtgcacttgctgaaagacacaagggcctgactggggtggaaggcagggcggcccccagctgtcatcaattaaagacaaaggcaattgaatcttaac

SEQ ID NO: 8 - DNA, 2386 bp, Macaca fascicularis
gttaagattcaattgcctttgtctttaattgatgacagctgggggccgccctgccttccaccccagtcaggcccttgtgtctttcagcaagtgcacggcgtggggccgcatgcctgccaggcccctgaggacactgaggacctgtccccagcacagggtgagccaggcgggggcccgagtccggggccctggtcagcagggagcgaagtgggcctcgccgaggtcccgcaggtcgagccccgcgacctcgggcgggctggtgcaggtgatgttgttgtaggtgtacacggggggttggcagtcgtccccctcacagatggcctggacgaagcggggcacggcactggggttctgcagggcaaagtcccatagcgccttgagggggcagctgcagtcccaggggttgccctccagccacaggcgctccaggccagggggctgcggcgtgaaggtccgcagtgagttgttcctgaggttgaggtaacgcagccgccccagcggtgccaagaggctgccgggcaacgcctccaggcggttgtgcgagacgtccagccagaaggcccgctgcagggggcccagggcatccgccggcagctccgccaggcggttgtgggagagcagcaggtactccagcttgcccaggccctggaagagctggtggggcaggtgcgtgagctggttggaggtcaggtcgagctccagcagctccgccagcccccacaggctctgctcctcaatgcccacgaggccgttgtccttgaggaagaggcggcggagccccgagaggccggcgaaggtgtgtgggcggatgcggcccaggcagctgccctccaggtgcaggctgtgcagcttgcccaggccccggaacacctgctccggaaggttccggagacagttcccagagaggttcatgaccgccacgttggtgaggccgaggaaggcgcccaccttgacctcctggagctggttgtggtccagcgtgagcacctcgagttgccccaggccctcaaagctgcgctcggccagctgccggatgcggttgtggcccagctgcagctcctccagaaagtgcaggtcctcgaaggtgcggggccgcaggctggcgatggcgttgtgggacagccgcagcacgcgcaggcccagcaggccggggaacgtgtcctccaggaggccagccacgcggttgtgggacaggtccagccatcgcagtgccttcaggcccaggaaggcgcccggggccacggcagcgatgaggttgcggtccaggtagagcttctggagccggggcagctgcgcgaacacgttggccttgatggcccgcagcgcgttcctgctcaggtccagctcccggagctcggccaggccgctgaagagtgcgggctgcaggtaggcaagcctgttgcccgccagcaccagctcgcgcaggccgcccagaccacggaacgccgcatcggggagcacggccaggctattccagccaaggttgaggtcccagaggttgccgaggccctcaaagagcccgtcctccagcctgctcaggcggttgttgctgaggcccagcgaggccagcgcgggtgtgtgcgcaaaggtgccgaccgccaggctgcgcagctggttccgctccaagtgcaggtggcacaggttctccaggcccagcagtgcctgcggctccaggctgcccagctggccgccctgcaagttgaggaaggccaggctggagaggttccggaaagccgccggggggatggacgagaggttgttgctgtccaaccacagggcttgggtgccgcccgggatcccgtcaggcaggcgcgtgaggttcctggagctgcagaagacgctgagctcattcgcctcctcatcgtagctgcaggcacaggtggccgggcatgctgggccctcggcttcccccggcgttccgggctctgctccctccaggctgcgggggccgagtgccacccaggacagcagcagcagcgccaaggccaggcctcctgccccttgctgtgccccaaggctctggtgagggcctggccgccccacagtcaccgcttgtgtgcagagaggccacgggaatgtgtgcccagccatgtccgaggccacccctgggctccgtctccacctgcctccagcggcccctcgctcccctccacctgctcagaccacttcccagtcagtcgctgtctccaccagggcctgagccgctgcagcccctcctctccaggtccctgctggcccctcctctggctgtcagcggggcctgcccaccagtccctcggcagtgggaaagcgttcagggaagcggccgggaggggcgcaggtggaggcagagccggggctggaggagaccgcagctctccaggccctaccccgtccgcggctccgg

SEQ ID NO: 9 - DNA, 2282 bp, Homo sapiens
ggaaatccagagggcaggggtggccggcacagcagacgtaccctccctcgctgcctgcctgcagcctgccctgcatgcaggatggccctgaggaaagcgggtgacctcgagcctcagttcacacctgagcgccgcttccggctgtgctggtatcaggctcactcgggcagagccctcctcgggccgcctccccaagcctctccccccgcaggaggcctggccctggcgctgctgctgctgtcctgggtggcactgggcccccgcagcctggagggagcagaccccggaacgccgggggaagccgagggcccagcgtgcccggccgcctgtgtctgcagctacgatgacgacgcggatgagctcagcgtcttctgcagctccaggaacctcacgcgcctgcctgatggagtcccgggcggcacccaagccctgtggctggacggcaacaacctctcgtccgtccccccggcagccttccagaacctctccagcctgggcttcctcaacctgcagggcggccagctgggcagcctggagccacaggcgctgctgggcctagagaacctgtgccacctgcacctggagcggaaccagctgcgcagcctggcactcggcacgtttgcacacacgcccgcgctggcctcgctcggcctcagcaacaaccgtctgagcaggctggaggacgggctcttcgagggcctcggcagcctctgggacctcaacctcggctggaatagcctggcggtgctccccgatgcggcgttccgcggcctgggcagcctgcgcgagctggtgctggcgggcaacaggctggcctacctgcagcccgcgctcttcagcggcctggccgagctccgggagctggacctgagcaggaacgcgctgcgggccatcaaggcaaacgtgttcgtgcagctgccccggctccagaaactctacctggaccgcaacctcatcgctgccgtggccccgggcgccttcctgggcctgaaggcgctgcgatggctggacctgtcccacaaccgcgtggctggcctcctggaggacacgttccccggtctgctgggcctgcgtgtgctgcggctgtcccacaacgccatcgccagcctgcggccccgcaccttcaaggacctgcacttcctggaggagctgcagctgggccacaaccgcatccggcagctggctgagcgcagctttgagggcctggggcagcttgaggtgctcacgctagaccacaaccagctccaggaggtcaaggcgggcgctttcctcggcctcaccaacgtggcggtcatgaacctctctgggaactgtctccggaaccttccggagcaggtgttccggggcctgggcaagctgcacagcctgcacctggagggcagctgcctgggacgcatccgcccgcacaccttcaccggcctctcggggctccgccgactcttcctcaaggacaacggcctcgtgggcattgaggagcagagcctgtgggggctggcggagctgctggagctcgacctgacctccaaccagctcacgcacctgccccaccgcctcttccagggcctgggcaagctggagtacctgctgctctcccgcaaccgcctggcagagctgccggcggacgccctgggccccctgcagcgggccttctggctggacgtctcgcacaaccgcctggaggcattgcccaacagcctcttggcaccactggggcggctgcgctacctcagcctcaggaacaactcactgcggaccttcacgccgcagcccccgggcctggagcgcctgtggctggagggtaacccctgggactgtggctgccctctcaaggcgctgcgggacttcgccctgcagaaccccagtgctgtgccccgcttcgtccaggccatctgtgagggggacgattgccagccgcccgcgtacacctacaacaacatcacctgtgccagcccgcccgaggtcgtggggctcgacctgcgggacctcagcgaggcccactttgctccctgctgaccaggtccccggactcaagccccggactcaggcccccacctggctcaccttgtgctggggacaggtcctcagtgtcctcaggggcctgcccagtgcacttgctggaagacgcaagggcctgatggggtggaaggcatggcggcccccccagctgtcatcaattaaaggcaaaggcaatcgaatctaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10 - DNA, 2282 bp, Homo sapiens
ttttttttttttttttttttttttttttttttttttttttttttttttttttttttttttttttttttttttttttttttttttagattcgattgcctttgcctttaattgatgacagctgggggggccgccatgccttccaccccatcaggcccttgcgtcttccagcaagtgcactgggcaggcccctgaggacactgaggacctgtccccagcacaaggtgagccaggtgggggcctgagtccggggcttgagtccggggacctggtcagcagggagcaaagtgggcctcgctgaggtcccgcaggtcgagccccacgacctcgggcgggctggcacaggtgatgttgttgtaggtgtacgcgggcggctggcaatcgtccccctcacagatggcctggacgaagcggggcacagcactggggttctgcagggcgaagtcccgcagcgccttgagagggcagccacagtcccaggggttaccctccagccacaggcgctccaggcccgggggctgcggcgtgaaggtccgcagtgagttgttcctgaggctgaggtagcgcagccgccccagtggtgccaagaggctgttgggcaatgcctccaggcggttgtgcgagacgtccagccagaaggcccgctgcagggggcccagggcgtccgccggcagctctgccaggcggttgcgggagagcagcaggtactccagcttgcccaggccctggaagaggcggtggggcaggtgcgtgagctggttggaggtcaggtcgagctccagcagctccgccagcccccacaggctctgctcctcaatgcccacgaggccgttgtccttgaggaagagtcggcggagccccgagaggccggtgaaggtgtgcgggcggatgcgtcccaggcagctgccctccaggtgcaggctgtgcagcttgcccaggccccggaacacctgctccggaaggttccggagacagttcccagagaggttcatgaccgccacgttggtgaggccgaggaaagcgcccgccttgacctcctggagctggttgtggtctagcgtgagcacctcaagctgccccaggccctcaaagctgcgctcagccagctgccggatgcggttgtggcccagctgcagctcctccaggaagtgcaggtccttgaaggtgcggggccgcaggctggcgatggcgttgtgggacagccgcagcacacgcaggcccagcagaccggggaacgtgtcctccaggaggccagccacgcggttgtgggacaggtccagccatcgcagcgccttcaggcccaggaaggcgcccggggccacggcagcgatgaggttgcggtccaggtagagtttctggagccggggcagctgcacgaacacgtttgccttgatggcccgcagcgcgttcctgctcaggtccagctcccggagctcggccaggccgctgaagagcgcgggctgcaggtaggccagcctgttgcccgccagcaccagctcgcgcaggctgcccaggccgcggaacgccgcatcggggagcaccgccaggctattccagccgaggttgaggtcccagaggctgccgaggccctcgaagagcccgtcctccagcctgctcagacggttgttgctgaggccgagcgaggccagcgcgggcgtgtgtgcaaacgtgccgagtgccaggctgcgcagctggttccgctccaggtgcaggtggcacaggttctctaggcccagcagcgcctgtggctccaggctgcccagctggccgccctgcaggttgaggaagcccaggctggagaggttctggaaggctgccggggggacggacgagaggttgttgccgtccagccacagggcttgggtgccgcccgggactccatcaggcaggcgcgtgaggttcctggagctgcagaagacgctgagctcatccgcgtcgtcatcgtagctgcagacacaggcggccgggcacgctgggccctcggcttcccccggcgttccggggtctgctccctccaggctgcgggggcccagtgccacccaggacagcagcagcagcgccagggccaggcctcctgcggggggagaggcttggggaggcggcccgaggagggctctgcccgagtgagcctgataccagcacagccggaagcggcgctcaggtgtgaactgaggctcgaggtcacccgctttcctcagggccatcctgcatgcagggcaggctgcaggcaggcagcgagggagggtacgtctgctgtgccggccacccctgccctctggatttcc

SEQ ID NO: 11 - DNA, 7415 bp, Homo sapiens
gaaggcaaatgttcccccagctgtttcctgtctacagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 12 - DNA, 7415 bp, Homo sapiens
gaactaattaatcaaacatgactaattttaatgtaattactaaagaaagatataccattttattatgacactctagccatacattttcaaaatatgcttattaaacagtaaatgtaagataatgattcaattagttacatttttagaagtcattaggattgatattcctctgccataagtgaattgaataataatttcaaatacaatcagaattaatttaataaaaaatatgcttttcaactaagacagatgtaacgaatggccagtcattattttctggtttcaaagtagcaggggaaattaattcagtgtctgtaagtttatttatcacacttggcctataagtgtgataaaaatacatgaggcaaaatacatgatgtaatcccaattctcatagttcattaactcttttaccaaaaagatctgacatggtatttggggcctttatgtaaactgaatataagctgcgtgatatttgaaaggttttgatattttgaatagacattttcatgatacacagacacagataaaagatgtaagtagacagcttgaggtttcagagtccctcctgcagtgtgtttagcagcgggtacaagataaatatccaaacaaaatcagattaagggattaacagaagtgactttgctatgagttggtgagtggggtcaatgggtggcttgaaagggattttagagctctgtttttatttttcctactttacatcagtgcattttgggcaaaataaaatgagtaatgtttacttttaggcctcagtaatataaaaaaaggcagattctaaggattgtggaaggtcatgtttttgaaagtgaaaggtaattcagctccggttattaggagaaactctgtctccatcttaactcatatttcagttgagcagtaacatttggttttgtgtcctctctttttttttttttactttaaaaaagcttggatttttttccccttgaaagaccccatcaaagatagttgaagaatgaggagagaaggatcatgtttaagatccatgtaatcatacattaagagggaacacatgggcagggtgtggtggctcatgcctgtaatcccagcaatttgggaggctgaggcgggcaaatcacaaggtcaggagtttgagaccaacctggccaacatggtaaaaccccgtctctattaaaaatccaaaaaattagccgggcatagtggtgggtgcctgtaatcccagctactcaggaggctgaggcaggagaatcgcttaaacccaggaggtggaggttgcagtgagccgagatcatgccactgcactccagcctgggggacagtgcgagaccccatctcacaaaaaggaaaaaaaaaaagagggaacacgtgaaatatatgttttcagtgaggttcctttaattctagagtttcagcttggtcagccctctataaaattctgaggcagatactaaaataataagggctgggttgggatgggggcagaataaagacagcttcaaaaatcccctgggcctctgtcttatctgtgagaggtttctttaaaaaacaaaagcattgttccagataggaattggttatttaaattgatatctttatcctgtaccatatgcacttaaagcttctgacagtcttctctcttttttaaatagaaattacacaaaaaagatatctatgtatcactttctaatacctaacaggaaggtcttataaaatattaaaatagcaataagcaaatatgtactacaggattaaacactagcattgaaaacaaaacaaaatccaaaaccaagaatcaacaacattttccttttgttgttgcccccctaccagatctggactttatggtctttgcaagggaggggcataaactttcacaattcttctgttttaaaataaatgatgccattgcataaatcagatttatcttttgaaaatattggtggaaagccatgtgatttgaatggaaagattctttcttctgaggagagccaaacaggttctgctctaataaattagcacaatcttttaagattaaaaatagcaaaacattttaaatagtctgattatagcttcaacaagtcaaacatacatttctatctagcctatagttttaaagagtctatgtgggtttaacttattattcctcattctgatataaaaaaagaagaaaagaaccaagtcattttgaacattaagaaattcataaagactgtataaagtaaaaaaaaaaaaaaaacaaaaacaagaaacaaaaaatcttcacagattgttagccatctctttcaacaatttctcataaattctttctttatcagtagataacccccatctcataaggaaatactttccaacatttcccaaatgagatcagtgattgcttttcatgagagctactgctctttgagatgtctgggtgaagggagaatgtcttctataaaccagtaaatgccaaagaatacccaagggggatttggcagaagctattttttgcaggtaaatctatgtattttttctctttgttcttattttctccacttgctgaatatctgttttagagcagagtgcacaaaaatcaataaggaacttacttatcttttaaattcttctatttgcctataagatcttttttcccgcgtttattctccatgctcttgatcaagttcagaagattggataatatattgctaattttgctaagtttgagagccaacaaaacaatggagccttctaactttaaaaaatttccaactcctgcccctgcacccccaaattcacaatttggtgaacagtacactacttgtgagtgataaaaagttgaaaggtggtggtggctagatagacctaatgctattttattaagccatctatctatagaattgttgtttttatactttaaaaaaatatgtctatgctttcttttttttctttttttcttttttttttagtcaagtactttcttaaagaaacaatagcaccacattggcatagctggccaaacaataaatgggaaagcaaaatgtgctacatcttttattctaagccttctcccaagtgcataaaatagtaacagaaaccctggagccacagagcatgagatggtttcatctacacaaacattgacgttccaaggagaggaaggattctcaagggtggacaggctttttgtttgtttgtttgttttttaataaaattttcaaggaagtgatttcttttcagtattccattggatccttagggtgaatgtgtgtgtgtgtgtgtgtgtgtgtgtgtgtgtgtgtgtctgtgtatgtagggtgggtgttaagagattttcatatccctagaagagtggattctgatggagagctgcattaactttttcaggggaactgcctcatcttaaaaagttcaaataatactttaatattatttggggaagagagaacagaaatttgacctaagtatccagtatggtcaattaaattggaaataagcctatgagttgaaagctcattcttaccaatgtttactgttcttttacaaatatcttgaaattgcctcattcaagaattataaagcaatctaattctgaagcaaagcttgtaaagttttgggttgtgacattttggttgctcctttctatgaaatctgagtcattctgctgtagtatatagtaatcaactgacttccagggtttgcatcaatttgttttctagttttaattcattaaaaaataaaatagtgaattggtataatgagttattttcaatttatttataatccagttggagaggattatgtgttggaaaaagttaagaaagataatatggcagtgcatctttcagctttcctccttgggggatttttgactgtggatagaattaagtgaaggaaataagtcatagacactcttagaattatcacatctaactatgacagaaaacacgttaagtctgcagaagactgcctataaagttttgttgagagggaataattttaaaaggtacacactggggacaagaaataaaaagaagtgccatcttgggaagaggagtccagtatcttattccacagaacctgtatgtctggaaaacaggcagagggcaaaaatgatgtatagtttcttttacatctgtccatagtgattagaacattgctaagcatgcttgaggtgctcaattcaaataatgttggactgagagttaaaatacttgttgactgaacaggattgctggctccactaaatggggccttctttttgcatatattcagagatccagggagtcttttttttttttttcctggcctctgatccttgaggtgacccagtgggagaaaaactgaagatgttatttttgtttttcatatagactttccaagaatgtaaaatatagaatttgcatgaaataatcaagcctgggtacttttaaccaaaaagttctaaggtgactagaaagatctgaatgctggataattcattgttctaatgagaaaatcttgatctgcagatagggatcattttctaggctatgatggactagtacactaaccagtggactttcttgataccaattttcagttgaatggataaaacacattcacagagagctaggggctacccttctgagcaggcatgggaaatttcttgttgtgatggaagtttttgcctttcaactggaaactctagtcaagcatattttaacaaacttttaaaaaaatgtatatacagctaagaataagagtaaagtttgttaaagaagataactttgtgactttttattagatattattttaatatttcaaattttggatcactttccttatattgcctagaaaagaaggaatcattgtgtttttcaaaatgaatagaatattatttatagtattaaacgaggttttactagatatgtagtaactgcatagaagagtcagtgagtgctaacaaagagtaattaattcccctttcactggtagaaatctctttgtttttctcctttttcttttcctttctctcttttcacttatctttgtattcataaaaccaaatgcagaattcaaaatcaaattgaaaatcaaatgcttcccacatattttgaaaagtgttttaagagattgagctgttagcttttaacaactagttggccagttatttggatagcttcactgacaagaactgagatgtcaggagcattcaattcaccaatctctagctatgctatgaatgggttatttatagaattccttgcatctcagcaactcaagcgccctgatgttgcacccttacagcaacccagggtaaaaaaaatctgaatctttatctttttaaaccttataccacccctttgaggtaggtagatgacatattgcccccattttgcagatgaggaaactgaggcacagagaggtgaagtgacttgcccaaggtcacacagtggtgagtccatgacacagctggcagatgttcatttcttccatgagaaaaagaaaccaggactgctaaaattcctagccttctgctttttccattccacagtttcctctctggactcgccagtccaatttgcatcagtggacttttgtgtctgaagttcctcttggaaggcataactggggggactttgccttctttcccaaatggatggtgttttcagtacccttccccttgtgtcatctttggctccaggcttcccctattgttttgctttcacgtattaccgttttggccagactctttcatataacaaactacaaaatagcaccattatactaaaaaacagagttttacatactgtttgatatatcctgtataattgatatgctaaatttacatagtgctctatatggaaaaaataaaaagaggaaagttactaattaggttgcacattaactcatcatttgaaggaactcttttgagttgaagaaactttctatgtttaaaacatatgcctaaaaatgattggcctcaaagttgcaactatttgcattattcttttttgtaagcatgatgtggaaaaataaagctttgtgtctaaaataaaatgcatccaacttatatttggtacaaatgccacagatggaatcttgtgggttagaattggtgtgcttcttgacgacttgctgctgcttttgaggaggccaaattcggcaaatataaaggttatgaagggaggtggtgggtatagactaacaagattatcagacactgtaaaacaaacagcccgagttgtgtagaaagaagtgcaaataaggaaacaattcataaaccacttagacaaggttgctgaatgaatggctccagcagccaagattcagagaggaatttagtgcaactggatctatacaacacccatgcatttgtggctcttgagaggcagggactaagatatatatatatatatattttttttttcttttctatagaacattattgataaaagatcaacagcaatctaccaactccaggaccatttttgcaaggtgcaaatcactcctaaagacaatgttggaatgtttacttgtgtatttcattgggggaaacgcccatcttttaaatgttatcaaacttattttttggtaggtgttccaaagtttaacaggtaactcgtgcagagcaaaggatcctgcggtggcatgtcactcttcactcctcaggagggtcttcctacatcctgtagttcttgtttcctgcactccctctacttgcgttcttcaaatgtacttcctttccttctctgagacttcgtgttcttgttggtagatgggggctgatacttctgggtcttgggcatgtcggtgtggcgctgggcacggacagagcgagctgacttggcaggcttgaggggtgcgcaatacatctccagcctccttagatcacagctccggaagcagcactcatccacgatgcctgtctgaggcgccctccgactgctggagccataccctgtgggcttgttgaaataaaagcccctgtctccacacacgaactgaagagcatccaccagctcagccccgcagagcgtctccggtccagccgtggcagagctggtgaaggtgagcaggcacagcgccaggtagaagagatgcgaggaggacatggtgtgcatcttcaccttcaagaaatcacaaaagcagcacttaaataattgggttggaagactgctgatttttcccattgcttctgaagtacaaagtctgaaaatgaattggttagcaggaataatgaagcaaaaagaaatccagagagatgggagatgttgagagcaatgtcacatttcaattttgaggactttattccattgcgcaggctctatctgctctgaatttagcagtgacagtgagatttagcaaacagaagagggatttagagaaaatcctcacatttatctacaaaacacagacactgtagacaggaaacagctgggggaacatttgccttc

SEQ ID NO: 13 - DNA, 7366 bp, Homo sapiens
gaaggcaaatgttcccccagctgtttcctgtctacagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 14 - DNA, 7366 bp, Homo sapiens
gaactaattaatcaaacatgactaattttaatgtaattactaaagaaagatataccattttattatgacactctagccatacattttcaaaatatgcttattaaacagtaaatgtaagataatgattcaattagttacatttttagaagtcattaggattgatattcctctgccataagtgaattgaataataatttcaaatacaatcagaattaatttaataaaaaatatgcttttcaactaagacagatgtaacgaatggccagtcattattttctggtttcaaagtagcaggggaaattaattcagtgtctgtaagtttatttatcacacttggcctataagtgtgataaaaatacatgaggcaaaatacatgatgtaatcccaattctcatagttcattaactcttttaccaaaaagatctgacatggtatttggggcctttatgtaaactgaatataagctgcgtgatatttgaaaggttttgatattttgaatagacattttcatgatacacagacacagataaaagatgtaagtagacagcttgaggtttcagagtccctcctgcagtgtgtttagcagcgggtacaagataaatatccaaacaaaatcagattaagggattaacagaagtgactttgctatgagttggtgagtggggtcaatgggtggcttgaaagggattttagagctctgtttttatttttcctactttacatcagtgcattttgggcaaaataaaatgagtaatgtttacttttaggcctcagtaatataaaaaaaggcagattctaaggattgtggaaggtcatgtttttgaaagtgaaaggtaattcagctccggttattaggagaaactctgtctccatcttaactcatatttcagttgagcagtaacatttggttttgtgtcctctctttttttttttttactttaaaaaagcttggatttttttccccttgaaagaccccatcaaagatagttgaagaatgaggagagaaggatcatgtttaagatccatgtaatcatacattaagagggaacacatgggcagggtgtggtggctcatgcctgtaatcccagcaatttgggaggctgaggcgggcaaatcacaaggtcaggagtttgagaccaacctggccaacatggtaaaaccccgtctctattaaaaatccaaaaaattagccgggcatagtggtgggtgcctgtaatcccagctactcaggaggctgaggcaggagaatcgcttaaacccaggaggtggaggttgcagtgagccgagatcatgccactgcactccagcctgggggacagtgcgagaccccatctcacaaaaaggaaaaaaaaaaagagggaacacgtgaaatatatgttttcagtgaggttcctttaattctagagtttcagcttggtcagccctctataaaattctgaggcagatactaaaataataagggctgggttgggatgggggcagaataaagacagcttcaaaaatcccctgggcctctgtcttatctgtgagaggtttctttaaaaaacaaaagcattgttccagataggaattggttatttaaattgatatctttatcctgtaccatatgcacttaaagcttctgacagtcttctctcttttttaaatagaaattacacaaaaaagatatctatgtatcactttctaatacctaacaggaaggtcttataaaatattaaaatagcaataagcaaatatgtactacaggattaaacactagcattgaaaacaaaacaaaatccaaaaccaagaatcaacaacattttccttttgttgttgcccccctaccagatctggactttatggtctttgcaagggaggggcataaactttcacaattcttctgttttaaaataaatgatgccattgcataaatcagatttatcttttgaaaatattggtggaaagccatgtgatttgaatggaaagattctttcttctgaggagagccaaacaggttctgctctaataaattagcacaatcttttaagattaaaaatagcaaaacattttaaatagtctgattatagcttcaacaagtcaaacatacatttctatctagcctatagttttaaagagtctatgtgggtttaacttattattcctcattctgatataaaaaaagaagaaaagaaccaagtcattttgaacattaagaaattcataaagactgtataaagtaaaaaaaaaaaaaaaacaaaaacaagaaacaaaaaatcttcacagattgttagccatctctttcaacaatttctcataaattctttctttatcagtagataacccccatctcataaggaaatactttccaacatttcccaaatgagatcagtgattgcttttcatgagagctactgctctttgagatgtctgggtgaagggagaatgtcttctataaaccagtaaatgccaaagaatacccaagggggatttggcagaagctattttttgcaggtaaatctatgtattttttctctttgttcttattttctccacttgctgaatatctgttttagagcagagtgcacaaaaatcaataaggaacttacttatcttttaaattcttctatttgcctataagatcttttttcccgcgtttattctccatgctcttgatcaagttcagaagattggataatatattgctaattttgctaagtttgagagccaacaaaacaatggagccttctaactttaaaaaatttccaactcctgcccctgcacccccaaattcacaatttggtgaacagtacactacttgtgagtgataaaaagttgaaaggtggtggtggctagatagacctaatgctattttattaagccatctatctatagaattgttgtttttatactttaaaaaaatatgtctatgctttcttttttttctttttttcttttttttttagtcaagtactttcttaaagaaacaatagcaccacattggcatagctggccaaacaataaatgggaaagcaaaatgtgctacatcttttattctaagccttctcccaagtgcataaaatagtaacagaaaccctggagccacagagcatgagatggtttcatctacacaaacattgacgttccaaggagaggaaggattctcaagggtggacaggctttttgtttgtttgtttgttttttaataaaattttcaaggaagtgatttcttttcagtattccattggatccttagggtgaatgtgtgtgtgtgtgtgtgtgtgtgtgtgtgtgtgtgtgtctgtgtatgtagggtgggtgttaagagattttcatatccctagaagagtggattctgatggagagctgcattaactttttcaggggaactgcctcatcttaaaaagttcaaataatactttaatattatttggggaagagagaacagaaatttgacctaagtatccagtatggtcaattaaattggaaataagcctatgagttgaaagctcattcttaccaatgtttactgttcttttacaaatatcttgaaattgcctcattcaagaattataaagcaatctaattctgaagcaaagcttgtaaagttttgggttgtgacattttggttgctcctttctatgaaatctgagtcattctgctgtagtatatagtaatcaactgacttccagggtttgcatcaatttgttttctagttttaattcattaaaaaataaaatagtgaattggtataatgagttattttcaatttatttataatccagttggagaggattatgtgttggaaaaagttaagaaagataatatggcagtgcatctttcagctttcctccttgggggatttttgactgtggatagaattaagtgaaggaaataagtcatagacactcttagaattatcacatctaactatgacagaaaacacgttaagtctgcagaagactgcctataaagttttgttgagagggaataattttaaaaggtacacactggggacaagaaataaaaagaagtgccatcttgggaagaggagtccagtatcttattccacagaacctgtatgtctggaaaacaggcagagggcaaaaatgatgtatagtttcttttacatctgtccatagtgattagaacattgctaagcatgcttgaggtgctcaattcaaataatgttggactgagagttaaaatacttgttgactgaacaggattgctggctccactaaatggggccttctttttgcatatattcagagatccagggagtcttttttttttttttcctggcctctgatccttgaggtgacccagtgggagaaaaactgaagatgttatttttgtttttcatatagactttccaagaatgtaaaatatagaatttgcatgaaataatcaagcctgggtacttttaaccaaaaagttctaaggtgactagaaagatctgaatgctggataattcattgttctaatgagaaaatcttgatctgcagatagggatcattttctaggctatgatggactagtacactaaccagtggactttcttgataccaattttcagttgaatggataaaacacattcacagagagctaggggctacccttctgagcaggcatgggaaatttcttgttgtgatggaagtttttgcctttcaactggaaactctagtcaagcatattttaacaaacttttaaaaaaatgtatatacagctaagaataagagtaaagtttgttaaagaagataactttgtgactttttattagatattattttaatatttcaaattttggatcactttccttatattgcctagaaaagaaggaatcattgtgtttttcaaaatgaatagaatattatttatagtattaaacgaggttttactagatatgtagtaactgcatagaagagtcagtgagtgctaacaaagagtaattaattcccctttcactggtagaaatctctttgtttttctcctttttcttttcctttctctcttttcacttatctttgtattcataaaaccaaatgcagaattcaaaatcaaattgaaaatcaaatgcttcccacatattttgaaaagtgttttaagagattgagctgttagcttttaacaactagttggccagttatttggatagcttcactgacaagaactgagatgtcaggagcattcaattcaccaatctctagctatgctatgaatgggttatttatagaattccttgcatctcagcaactcaagcgccctgatgttgcacccttacagcaacccagggtaaaaaaaatctgaatctttatctttttaaaccttataccacccctttgaggtaggtagatgacatattgcccccattttgcagatgaggaaactgaggcacagagaggtgaagtgacttgcccaaggtcacacagtggtgagtccatgacacagctggcagatgttcatttcttccatgagaaaaagaaaccaggactgctaaaattcctagccttctgctttttccattccacagtttcctctctggactcgccagtccaatttgcatcagtggacttttgtgtctgaagttcctcttggaaggcataactggggggactttgccttctttcccaaatggatggtgttttcagtacccttccccttgtgtcatctttggctccaggcttcccctattgttttgctttcacgtattaccgttttggccagactctttcatataacaaactacaaaatagcaccattatactaaaaaacagagttttacatactgtttgatatatcctgtataattgatatgctaaatttacatagtgctctatatggaaaaaataaaaagaggaaagttactaattaggttgcacattaactcatcatttgaaggaactcttttgagttgaagaaactttctatgtttaaaacatatgcctaaaaatgattggcctcaaagttgcaactatttgcattattcttttttgtaagcatgatgtggaaaaataaagctttgtgtctaaaataaaatgcatccaacttatatttggtacaaatgccacagatggaatcttgtgggttagaattggtgtgcttcttgacgacttgctgctgcttttgaggaggccaaattcggcaaatataaaggttatgaagggaggtggtgggtatagactaacaagattatcagacactgtaaaacaaacagcccgagttgtgtagaaagaagtgcaaataaggaaacaattcataaaccacttagacaaggttgctgaatgaatggctccagcagccaagattcagagaggaatttagtgcaactggatctatacaacacccatgcatttgtggctcttgagaggcagggactaagatatatatatatatatattttttttttcttttctatagaacattattgataaaagatcaacagcaatctaccaactccaggaccatttttgcaaggtgcaaatcactcctaaagacaatgttggaatgtttacttgtgtatttcattgggggaaacgcccatcttttaaatgttatcaaacttattttttggtaggtgttccaaagtttaacaggtaactcgtgcagagcaaaggatcctgcggtggcatgtcactcttcactcctcaggagggtcttcctacatcctgtagttcttgtttcctgcactccctctacttgcgttcttcaaatgtacttccttctgggtcttgggcatgtcggtgtggcgctgggcacggacagagcgagctgacttggcaggcttgaggggtgcgcaatacatctccagcctccttagatcacagctccggaagcagcactcatccacgatgcctgtctgaggcgccctccgactgctggagccataccctgtgggcttgttgaaataaaagcccctgtctccacacacgaactgaagagcatccaccagctcagccccgcagagcgtctccggtccagccgtggcagagctggtgaaggtgagcaggcacagcgccaggtagaagagatgcgaggaggacatggtgtgcatcttcaccttcaagaaatcacaaaagcagcacttaaataattgggttggaagactgctgatttttcccattgcttctgaagtacaaagtctgaaaatgaattggttagcaggaataatgaagcaaaaagaaatccagagagatgggagatgttgagagcaatgtcacatttcaattttgaggactttattccattgcgcaggctctatctgctctgaatttagcagtgacagtgagatttagcaaacagaagagggatttagagaaaatcctcacatttatctacaaaacacagacactgtagacaggaaacagctgggggaacatttgccttc

SEQ ID NO: 15 - DNA, 7204 bp, Homo sapiens
gcatacctgcctgggtgtccaaatgtaactagatgctttcacaaaccccacccacaaagcagcacatgtttttaagacttcagttttctattcacatcggcctcataatacccaccctgacctgctgtaaaagacctggaacaaacaaaaatgattacacctacagtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 16 - DNA, 7204 bp, Homo sapiens
gaactaattaatcaaacatgactaattttaatgtaattactaaagaaagatataccattttattatgacactctagccatacattttcaaaatatgcttattaaacagtaaatgtaagataatgattcaattagttacatttttagaagtcattaggattgatattcctctgccataagtgaattgaataataatttcaaatacaatcagaattaatttaataaaaaatatgcttttcaactaagacagatgtaacgaatggccagtcattattttctggtttcaaagtagcaggggaaattaattcagtgtctgtaagtttatttatcacacttggcctataagtgtgataaaaatacatgaggcaaaatacatgatgtaatcccaattctcatagttcattaactcttttaccaaaaagatctgacatggtatttggggcctttatgtaaactgaatataagctgcgtgatatttgaaaggttttgatattttgaatagacattttcatgatacacagacacagataaaagatgtaagtagacagcttgaggtttcagagtccctcctgcagtgtgtttagcagcgggtacaagataaatatccaaacaaaatcagattaagggattaacagaagtgactttgctatgagttggtgagtggggtcaatgggtggcttgaaagggattttagagctctgtttttatttttcctactttacatcagtgcattttgggcaaaataaaatgagtaatgtttacttttaggcctcagtaatataaaaaaaggcagattctaaggattgtggaaggtcatgtttttgaaagtgaaaggtaattcagctccggttattaggagaaactctgtctccatcttaactcatatttcagttgagcagtaacatttggttttgtgtcctctctttttttttttttactttaaaaaagcttggatttttttccccttgaaagaccccatcaaagatagttgaagaatgaggagagaaggatcatgtttaagatccatgtaatcatacattaagagggaacacatgggcagggtgtggtggctcatgcctgtaatcccagcaatttgggaggctgaggcgggcaaatcacaaggtcaggagtttgagaccaacctggccaacatggtaaaaccccgtctctattaaaaatccaaaaaattagccgggcatagtggtgggtgcctgtaatcccagctactcaggaggctgaggcaggagaatcgcttaaacccaggaggtggaggttgcagtgagccgagatcatgccactgcactccagcctgggggacagtgcgagaccccatctcacaaaaaggaaaaaaaaaaagagggaacacgtgaaatatatgttttcagtgaggttcctttaattctagagtttcagcttggtcagccctctataaaattctgaggcagatactaaaataataagggctgggttgggatgggggcagaataaagacagcttcaaaaatcccctgggcctctgtcttatctgtgagaggtttctttaaaaaacaaaagcattgttccagataggaattggttatttaaattgatatctttatcctgtaccatatgcacttaaagcttctgacagtcttctctcttttttaaatagaaattacacaaaaaagatatctatgtatcactttctaatacctaacaggaaggtcttataaaatattaaaatagcaataagcaaatatgtactacaggattaaacactagcattgaaaacaaaacaaaatccaaaaccaagaatcaacaacattttccttttgttgttgcccccctaccagatctggactttatggtctttgcaagggaggggcataaactttcacaattcttctgttttaaaataaatgatgccattgcataaatcagatttatcttttgaaaatattggtggaaagccatgtgatttgaatggaaagattctttcttctgaggagagccaaacaggttctgctctaataaattagcacaatcttttaagattaaaaatagcaaaacattttaaatagtctgattatagcttcaacaagtcaaacatacatttctatctagcctatagttttaaagagtctatgtgggtttaacttattattcctcattctgatataaaaaaagaagaaaagaaccaagtcattttgaacattaagaaattcataaagactgtataaagtaaaaaaaaaaaaaaaacaaaaacaagaaacaaaaaatcttcacagattgttagccatctctttcaacaatttctcataaattctttctttatcagtagataacccccatctcataaggaaatactttccaacatttcccaaatgagatcagtgattgcttttcatgagagctactgctctttgagatgtctgggtgaagggagaatgtcttctataaaccagtaaatgccaaagaatacccaagggggatttggcagaagctattttttgcaggtaaatctatgtattttttctctttgttcttattttctccacttgctgaatatctgttttagagcagagtgcacaaaaatcaataaggaacttacttatcttttaaattcttctatttgcctataagatcttttttcccgcgtttattctccatgctcttgatcaagttcagaagattggataatatattgctaattttgctaagtttgagagccaacaaaacaatggagccttctaactttaaaaaatttccaactcctgcccctgcacccccaaattcacaatttggtgaacagtacactacttgtgagtgataaaaagttgaaaggtggtggtggctagatagacctaatgctattttattaagccatctatctatagaattgttgtttttatactttaaaaaaatatgtctatgctttcttttttttctttttttcttttttttttagtcaagtactttcttaaagaaacaatagcaccacattggcatagctggccaaacaataaatgggaaagcaaaatgtgctacatcttttattctaagccttctcccaagtgcataaaatagtaacagaaaccctggagccacagagcatgagatggtttcatctacacaaacattgacgttccaaggagaggaaggattctcaagggtggacaggctttttgtttgtttgtttgttttttaataaaattttcaaggaagtgatttcttttcagtattccattggatccttagggtgaatgtgtgtgtgtgtgtgtgtgtgtgtgtgtgtgtgtgtgtctgtgtatgtagggtgggtgttaagagattttcatatccctagaagagtggattctgatggagagctgcattaactttttcaggggaactgcctcatcttaaaaagttcaaataatactttaatattatttggggaagagagaacagaaatttgacctaagtatccagtatggtcaattaaattggaaataagcctatgagttgaaagctcattcttaccaatgtttactgttcttttacaaatatcttgaaattgcctcattcaagaattataaagcaatctaattctgaagcaaagcttgtaaagttttgggttgtgacattttggttgctcctttctatgaaatctgagtcattctgctgtagtatatagtaatcaactgacttccagggtttgcatcaatttgttttctagttttaattcattaaaaaataaaatagtgaattggtataatgagttattttcaatttatttataatccagttggagaggattatgtgttggaaaaagttaagaaagataatatggcagtgcatctttcagctttcctccttgggggatttttgactgtggatagaattaagtgaaggaaataagtcatagacactcttagaattatcacatctaactatgacagaaaacacgttaagtctgcagaagactgcctataaagttttgttgagagggaataattttaaaaggtacacactggggacaagaaataaaaagaagtgccatcttgggaagaggagtccagtatcttattccacagaacctgtatgtctggaaaacaggcagagggcaaaaatgatgtatagtttcttttacatctgtccatagtgattagaacattgctaagcatgcttgaggtgctcaattcaaataatgttggactgagagttaaaatacttgttgactgaacaggattgctggctccactaaatggggccttctttttgcatatattcagagatccagggagtcttttttttttttttcctggcctctgatccttgaggtgacccagtgggagaaaaactgaagatgttatttttgtttttcatatagactttccaagaatgtaaaatatagaatttgcatgaaataatcaagcctgggtacttttaaccaaaaagttctaaggtgactagaaagatctgaatgctggataattcattgttctaatgagaaaatcttgatctgcagatagggatcattttctaggctatgatggactagtacactaaccagtggactttcttgataccaattttcagttgaatggataaaacacattcacagagagctaggggctacccttctgagcaggcatgggaaatttcttgttgtgatggaagtttttgcctttcaactggaaactctagtcaagcatattttaacaaacttttaaaaaaatgtatatacagctaagaataagagtaaagtttgttaaagaagataactttgtgactttttattagatattattttaatatttcaaattttggatcactttccttatattgcctagaaaagaaggaatcattgtgtttttcaaaatgaatagaatattatttatagtattaaacgaggttttactagatatgtagtaactgcatagaagagtcagtgagtgctaacaaagagtaattaattcccctttcactggtagaaatctctttgtttttctcctttttcttttcctttctctcttttcacttatctttgtattcataaaaccaaatgcagaattcaaaatcaaattgaaaatcaaatgcttcccacatattttgaaaagtgttttaagagattgagctgttagcttttaacaactagttggccagttatttggatagcttcactgacaagaactgagatgtcaggagcattcaattcaccaatctctagctatgctatgaatgggttatttatagaattccttgcatctcagcaactcaagcgccctgatgttgcacccttacagcaacccagggtaaaaaaaatctgaatctttatctttttaaaccttataccacccctttgaggtaggtagatgacatattgcccccattttgcagatgaggaaactgaggcacagagaggtgaagtgacttgcccaaggtcacacagtggtgagtccatgacacagctggcagatgttcatttcttccatgagaaaaagaaaccaggactgctaaaattcctagccttctgctttttccattccacagtttcctctctggactcgccagtccaatttgcatcagtggacttttgtgtctgaagttcctcttggaaggcataactggggggactttgccttctttcccaaatggatggtgttttcagtacccttccccttgtgtcatctttggctccaggcttcccctattgttttgctttcacgtattaccgttttggccagactctttcatataacaaactacaaaatagcaccattatactaaaaaacagagttttacatactgtttgatatatcctgtataattgatatgctaaatttacatagtgctctatatggaaaaaataaaaagaggaaagttactaattaggttgcacattaactcatcatttgaaggaactcttttgagttgaagaaactttctatgtttaaaacatatgcctaaaaatgattggcctcaaagttgcaactatttgcattattcttttttgtaagcatgatgtggaaaaataaagctttgtgtctaaaataaaatgcatccaacttatatttggtacaaatgccacagatggaatcttgtgggttagaattggtgtgcttcttgacgacttgctgctgcttttgaggaggccaaattcggcaaatataaaggttatgaagggaggtggtgggtatagactaacaagattatcagacactgtaaaacaaacagcccgagttgtgtagaaagaagtgcaaataaggaaacaattcataaaccacttagacaaggttgctgaatgaatggctccagcagccaagattcagagaggaatttagtgcaactggatctatacaacacccatgcatttgtggctcttgagaggcagggactaagatatatatatatatatattttttttttcttttctatagaacattattgataaaagatcaacagcaatctaccaactccaggaccatttttgcaaggtgcaaatcactcctaaagacaatgttggaatgtttacttgtgtatttcattgggggaaacgcccatcttttaaatgttatcaaacttattttttggtaggtgttccaaagtttaacaggtaactcgtgcagagcaaaggatcctgcggtggcatgtcactcttcactcctcaggagggtcttcctacatcctgtagttcttgtttcctgcactccctctacttgcgttcttcaaatgtacttccttctgggtcttgggcatgtcggtgtggcgctgggcacggacagagcgagctgacttggcaggcttgaggggtgcgcaatacatctccagcctccttagatcacagctccggaagcagcactcatccacgatgcctgtctgaggcgccctccgactgctggagccataccctgtgggcttgttgaaataaaagcccctgtctccacacacgaactgaagagcatccaccagctcagccccgcagagcgtctccggtccagccgtggcagagctggtgaaggtgagcaggcacagcgccaggtagaagagatgcgaggaggacatggtgtgcatcttcactgtaggtgtaatcatttttgtttgttccaggtcttttacagcaggtcagggtgggtattatgaggccgatgtgaatagaaaactgaagtcttaaaaacatgtgctgctttgtgggtggggtttgtgaaagcatctagttacatttggacacccaggcaggtatgc

SEQ ID NO: 17 - DNA, 7125 bp, Mus musculus
actcgataactttgccagaagagggagagagagagaaggcgaatgttcccccagctgtttcctgtctacagtgtctgtgttttgtagataaatgtgaggattttctctaaatccctcttctgcttgctaaatctcactgtcactgctaaattcagagcagatagagcctgcgcaatggaataaagtcctcaaaattgaaatgtgacattgctctaacatctcccatctctctggatttctttttcgcctcattatccctgcccaccaattcatttccagactttgtacttcagaagcgatggggaaaatcagcagccttccaactcaattatttaagatctgcctctgtgacttcttgaagataaagatacacatcatgtcgtcttcacacctcttctacctggcgctctgcttgctcaccttcaccagctccaccacagctggaccagagaccctttgcggggctgagctggtggatgctcttcagttcgtgtgtggaccgaggggcttttacttcaacaagcccacaggctatggctccagcattcggagggcacctcagacaggcattgtggatgagtgttgcttccggagctgtgatctgaggagactggagatgtactgtgccccactgaagcctacaaaagcagcccgctctatccgtgcccagcgccacactgacatgcccaagactcagaagtccccgtccctatcgacaaacaagaaaacgaagctgcaaaggagaaggaaaggaagtacatttgaagaacacaagtagaggaagtgcaggaaacaagacctacagaatgtaggaggagcctcccacggagcagaaaatgccacatcaccgcaggatcctttgctgcttgagcaacctgcaaaacatcgaaacacctaccaaataacaataataagtccaataacattacaaagatgggcatttcccccaatgaaatatacaagtaaacattccaacatcgtctttaggagtgtttgtttaaaaagctttgcaccttgcaaaagtggtcctggcgtgggtagattgctgttggtcctttatcaataacattctatagagaaaaaaaatatatatataactatatctcctagtccctgcctctaaagagccgaaaatgcatggatgttgtagagatccagttgctctaagtttctctctgaattttggctgctgaagccattcatttagcaactgtgtagaggtggtttatgaatggttcccttatcttcacctcttcccacgtagctcaagctgcttgttttacagagtctaatcatcttgtctagctgcattagacacaccctttcctaacacttgtatttgttgaatttggcctccttaagagcaatagcaaataagtagtcaagtggcctaccaagttttaacgtacctgactccatctgtggcatttgtaccaaatataagttgaatgcatttattttagacacaaagctttattttttttgacattgtgtttcaagaaaaaaaatagaataacaataactacaactttgaggccaatcatttttaggtgtgtgtttgaagcatagaacgtctcttaaactctcaatggtttcttcaaatgataagttagtatgtaacctaagtatagcagtttctctcttttttatttttttccatatagagcactatgtaaagttagtatatcaataatacaggaaatatcaaacagtatgtaaaactctgttgttgttgttttttagtacaatggtgctattttgtagtttgttatatgaaagaatctagtcaacacagtaaaaggagaaagcaaagcaaaaacaacaaacgaaagcctggagcctaagatgacaaaacgaggaagggaactgaaaaaaaaaatccttcctcttgggagatgcaaaggcctccccaattatgccttccaagaagaacttaagatatagagtccattaagacgcacttacttgtcaagtccagagaggaagctatggagtgggaaaagcaagaggctagggatttgggagtcctggtttctttttaatcactgaagaagtaagtatttgcaacctgggtcacacaaactcaccaccctgtgacctcagtcaaatcactccacctctcggtgcctcagttttcctcatctgcaaaatgggggcaatatgtcatctacctacctcaaaggggtggtatgaagattaaaaagtagaccttcagatttttgttctgggtttccaggagggtgcaacatcagaacccttgaattgctaggatgcaaggaattctgtaaataacccactaacaatgtagctccaaggatcattcatctgtcactgggatgccaccacaatatccaagttcttattggtgaagctgtgcaactaattagtgacaagctaaggactcagtctccccagcatgtcacacggcaggagacatttgatttgcagttttatttaacttctgcatttgagcttatgactataaagactagtgaaaagaagggagagaggagaaagaagatccttgccaagtaaagggtaattaattattattccatttatccactctcattaaagggtaattaattattccatgtatccactctcattaatccttccagtcacttagtatctagaaataactctaacattgtcaatgagactctactcagtttgccaaacacaattctccttccccatagcatatgaaaaaaaggcgctgacattcttaaattttgaaatagtatctattacaatcacaggttgctgtagcagatgtagtcttgcccttgtttgtacatgcatgtattttttttttaattttatgaaaatgtgctagcaagaattgctacttgaggggcaaaattcttccttctcaagcctgaggttctccctagtgtctgcttagaaggaaggatccagcttcctggaaatgtgttggatgcattcaactgggcattgctaaccaaaaacatttagaaaaatgttctctatgtatatagcaagattgtctccctcttttaaaaacaaaatccaatattcacatcttattacctacaaccttgattctctattgcaagcttccttaatattcttataaaatgtattaagaaaaacaaaaaggacacctttagctctccttccgccaggttgcctctagaatctctggggaaatgcagaaggtgctgttgagtaaagccctcagaaggattggatttaggaacatcaggcacgctgtacatcccctgattactgtagaaatgtaaatggaataagaggtcagctgaccatccacctgcttccccagaaggatacagggaaaagttaggccctcacacaccctgggtgacacttctgacttctagttcttgttcacagtgtgtactttttcaaattggtaattcccagaaaaacacataggtggccttctccagatctgtgggcttcctgccatggttggatttggtgattccaagtgtctatcacatattttgttcacttaattctatccacagtcagaaattctttcaatgaggaaagtttaaatatgcaatcctttatccaatacctaattctctccaactgcatcataaatcaagtaataaaaattaattgtactaattaatcataataatgtaccattgtacttttaaatgaatgaacactgcaagacaaatctatgtaaactctgaaaagtaactgatcattatatggtgaatcaaaatgactcaagattgatagaaagggacatttaaaattttacaactcaaaattttgtagactttgctatggaggtaaattgttttagtgcctagagatggagcggttttaataaatttacaaaagaactataaagataggtaggaaggaattttcatttgataggattgttgctgatttacttactcaatacctaggtcaaatgttgatcctattctccaaagactatcaagtgcttgaacattgtaagatgagtctgctccactgaaaatgtaatacatctctccattataatctattttcctggggtaaaaaaatcctttttttaaatatccacctacatatacctaccctacatgtgcatttgcacatgcgtgcatacgctcatgcgccccaccccacacacacctattcaccctaagactaagaagaaatcatttctttgaaagtcttatctttcaaaaaaggcagcggtgccccttgagactccttctccttctttgaatgtcaatgtgaaatgtggcatgtctgtgtacatgaaaccatctcataccctatggctccagggtttctttatggtttgtgcacttgggaggatgcgcagaagacaggatgcagcctgttttgctttcccctttactgtttggccagctacgccaatgtggtgctattgtttctttaagaaagtacttgactaaaaaaaaagaaaaaaagaaaaaaagaaaagaaaaagaaaaaagaaaaaaaaagaaagcatagacctatttttttaaagtctgaaaacaacagttctatagtagatggcttactgagatagcattagatctagccaccaccctagccaccacctttcaactatgtgtcactcacaagtagaatattgttcaccaagttgtgagtttgggggttcagagacaaaggatggaaaagttttaaagttagatggctcaatcatttcattggctctcaaatttaacaaaattggcaatacttcacccaatctgaagtgttggtcaataacttgaactgggggcaaaaataacttcaggcaaatggcagaagaaaataattaacttacttcttgctttttttgttgattgtttggtttcctgttgatttttggttttggttttgctgtgggtgggtgagtacatgtgtgtaagtacgtgtgtgtgtgtgtgtgtgtgtgtgtgtgtgtgtgttccactcaaaaacaaatactcagaaagtggagaaaatacaacgattttaagagcatagacttacctactactagaaccagcttctgtcacatcctctggagaaggcactgatttcttgttttgtagaggttgctcttccatcagtgacctgaaagagtgaccagtctcctagagtagacatggatctcattaggagaagacagaagtatttccttatgaattgggcttatctactgacaaagaaagggaagagtttatgagaagttattgaagaagatggctaacagtctgtgaagattttgttctggttttttttgttgttgttgttgttgggtttgggttttgatttttttttttttttttttactttatacaatctttatgaatggaaatcttaatgctcaaaaagacttggtctttttttctctttcgtaacagaatggaagatgacaaactcacatagactctttctaggctggctagcaaaggtgtggtttgacttatttgaatcagaccattttaaatgttcctctctatttttaatcataaaaggctgtcataatttattagcgtaggccctttttggcacttctcaaatgaatgagcattcccattcaaagcatggctttccccatggttccaaaacatgaatgattaatattaaggaattatttacttcaaaatacagtagaagtgtgagtctctgttcccattccccacaaagatcattaagtcctgaatcgggggcgggggtggggcgcctggatactaagggaatttttttgttgcttgttttttgttttcaatgctagtgcttaatcctatagtatacagatttgcttcttgctattgtgatattctgtaagactttcctgttaggtattagaaattgatacataaataccttttttgtgtggtttctatttaaaaggaaagagataagactgtctgaaccttaaattcgtaaggcacatgataaagagatcacattaaataacaagccatatctggttcaatcctttctttcttatcattttaaggaaaacttgcccagataagacagaggcccaggggacttttgaaactctctttgttccgccaattcattttggctggtgatggtttttccccagtgtctgcctcagaatcttttagaggctggccagactaaagactgtcttttaaaacacatttcacatggttcctcttaatgaatgattacacttatgtagaacatgatttttttttctctccacttattttttttttccccatcattgataagggttcttaaggagaagaattcattaacaaaactcaagaaagcgtacaaaaaaaaaattctaaatgtcactgcccaattgaaatacgagctaaaatggaaatactttctcctacttaaaacccagactgaatcaccttcaaaatgacctttcacaatctttccaatttgcctttgtttaaactgtctgggcctaaaagcaagcattattcattttctcttgcccaaagtgaacttgtgtaaagtaggaaaattaaaagaaactgctagaaatcccttccaaccagtggctgacccctctcactagctcacagcaaagtctcctctgttgatctatcacctagtctcatttcgtttgaatatttacattgtacctactgctaaacacttggcaggaggctccatccatatctcctatcggtgtctctgtatccttaaaccttgcaaacatcatacagtgtatattaagtttacaggaaagctccaaatagcatatcagacctggtctctctttgttaaagatttaaggagctatgggaatctggattacaacgcacattttgcttcatttatttttatcacactttaaaggccaagggtgatgattaacttacagacactgaattgatttccctactgaaacctgaaagtaatatttggtcattcattgtatgtgttttacacaaaaaaaacatcttctatcaaattactcctgattgtatttgaagtggttattcaattcatttatggcagagcaatatctgtcctaatgactcttataaaatgtaactaactgaatcattatcttacatttactgtttagtaagcatattttgaaattgtatggctagagtgtcataataaaatggtatatctttctttagtaattacattaaaattaatcatgtttgattaactggt

SEQ ID NO: 18 - DNA, 7125 bp, Mus musculus
accagttaatcaaacatgattaattttaatgtaattactaaagaaagatataccattttattatgacactctagccatacaatttcaaaatatgcttactaaacagtaaatgtaagataatgattcagttagttacattttataagagtcattaggacagatattgctctgccataaatgaattgaataaccacttcaaatacaatcaggagtaatttgatagaagatgttttttttgtgtaaaacacatacaatgaatgaccaaatattactttcaggtttcagtagggaaatcaattcagtgtctgtaagttaatcatcacccttggcctttaaagtgtgataaaaataaatgaagcaaaatgtgcgttgtaatccagattcccatagctccttaaatctttaacaaagagagaccaggtctgatatgctatttggagctttcctgtaaacttaatatacactgtatgatgtttgcaaggtttaaggatacagagacaccgataggagatatggatggagcctcctgccaagtgtttagcagtaggtacaatgtaaatattcaaacgaaatgagactaggtgatagatcaacagaggagactttgctgtgagctagtgagaggggtcagccactggttggaagggatttctagcagtttcttttaattttcctactttacacaagttcactttgggcaagagaaaatgaataatgcttgcttttaggcccagacagtttaaacaaaggcaaattggaaagattgtgaaaggtcattttgaaggtgattcagtctgggttttaagtaggagaaagtatttccattttagctcgtatttcaattgggcagtgacatttagaattttttttttgtacgctttcttgagttttgttaatgaattcttctccttaagaacccttatcaatgatggggaaaaaaaaaataagtggagagaaaaaaaaatcatgttctacataagtgtaatcattcattaagaggaaccatgtgaaatgtgttttaaaagacagtctttagtctggccagcctctaaaagattctgaggcagacactggggaaaaaccatcaccagccaaaatgaattggcggaacaaagagagtttcaaaagtcccctgggcctctgtcttatctgggcaagttttccttaaaatgataagaaagaaaggattgaaccagatatggcttgttatttaatgtgatctctttatcatgtgccttacgaatttaaggttcagacagtcttatctctttccttttaaatagaaaccacacaaaaaaggtatttatgtatcaatttctaatacctaacaggaaagtcttacagaatatcacaatagcaagaagcaaatctgtatactataggattaagcactagcattgaaaacaaaaaacaagcaacaaaaaaattcccttagtatccaggcgccccacccccgcccccgattcaggacttaatgatctttgtggggaatgggaacagagactcacacttctactgtattttgaagtaaataattccttaatattaatcattcatgttttggaaccatggggaaagccatgctttgaatgggaatgctcattcatttgagaagtgccaaaaagggcctacgctaataaattatgacagccttttatgattaaaaatagagaggaacatttaaaatggtctgattcaaataagtcaaaccacacctttgctagccagcctagaaagagtctatgtgagtttgtcatcttccattctgttacgaaagagaaaaaaagaccaagtctttttgagcattaagatttccattcataaagattgtataaagtaaaaaaaaaaaaaaaaaaatcaaaacccaaacccaacaacaacaacaacaaaaaaaaccagaacaaaatcttcacagactgttagccatcttcttcaataacttctcataaactcttccctttctttgtcagtagataagcccaattcataaggaaatacttctgtcttctcctaatgagatccatgtctactctaggagactggtcactctttcaggtcactgatggaagagcaacctctacaaaacaagaaatcagtgccttctccagaggatgtgacagaagctggttctagtagtaggtaagtctatgctcttaaaatcgttgtattttctccactttctgagtatttgtttttgagtggaacacacacacacacacacacacacacacacacacacgtacttacacacatgtactcacccacccacagcaaaaccaaaaccaaaaatcaacaggaaaccaaacaatcaacaaaaaaagcaagaagtaagttaattattttcttctgccatttgcctgaagttatttttgcccccagttcaagttattgaccaacacttcagattgggtgaagtattgccaattttgttaaatttgagagccaatgaaatgattgagccatctaactttaaaacttttccatcctttgtctctgaacccccaaactcacaacttggtgaacaatattctacttgtgagtgacacatagttgaaaggtggtggctagggtggtggctagatctaatgctatctcagtaagccatctactatagaactgttgttttcagactttaaaaaaataggtctatgctttctttttttttcttttttctttttcttttctttttttctttttttctttttttttagtcaagtactttcttaaagaaacaatagcaccacattggcgtagctggccaaacagtaaaggggaaagcaaaacaggctgcatcctgtcttctgcgcatcctcccaagtgcacaaaccataaagaaaccctggagccatagggtatgagatggtttcatgtacacagacatgccacatttcacattgacattcaaagaaggagaaggagtctcaaggggcaccgctgccttttttgaaagataagactttcaaagaaatgatttcttcttagtcttagggtgaataggtgtgtgtggggtggggcgcatgagcgtatgcacgcatgtgcaaatgcacatgtagggtaggtatatgtaggtggatatttaaaaaaaggatttttttaccccaggaaaatagattataatggagagatgtattacattttcagtggagcagactcatcttacaatgttcaagcacttgatagtctttggagaataggatcaacatttgacctaggtattgagtaagtaaatcagcaacaatcctatcaaatgaaaattccttcctacctatctttatagttcttttgtaaatttattaaaaccgctccatctctaggcactaaaacaatttacctccatagcaaagtctacaaaattttgagttgtaaaattttaaatgtccctttctatcaatcttgagtcattttgattcaccatataatgatcagttacttttcagagtttacatagatttgtcttgcagtgttcattcatttaaaagtacaatggtacattattatgattaattagtacaattaatttttattacttgatttatgatgcagttggagagaattaggtattggataaaggattgcatatttaaactttcctcattgaaagaatttctgactgtggatagaattaagtgaacaaaatatgtgatagacacttggaatcaccaaatccaaccatggcaggaagcccacagatctggagaaggccacctatgtgtttttctgggaattaccaatttgaaaaagtacacactgtgaacaagaactagaagtcagaagtgtcacccagggtgtgtgagggcctaacttttccctgtatccttctggggaagcaggtggatggtcagctgacctcttattccatttacatttctacagtaatcaggggatgtacagcgtgcctgatgttcctaaatccaatccttctgagggctttactcaacagcaccttctgcatttccccagagattctagaggcaacctggcggaaggagagctaaaggtgtcctttttgtttttcttaatacattttataagaatattaaggaagcttgcaatagagaatcaaggttgtaggtaataagatgtgaatattggattttgtttttaaaagagggagacaatcttgctatatacatagagaacatttttctaaatgtttttggttagcaatgcccagttgaatgcatccaacacatttccaggaagctggatccttccttctaagcagacactagggagaacctcaggcttgagaaggaagaattttgcccctcaagtagcaattcttgctagcacattttcataaaattaaaaaaaaaatacatgcatgtacaaacaagggcaagactacatctgctacagcaacctgtgattgtaatagatactatttcaaaatttaagaatgtcagcgcctttttttcatatgctatggggaaggagaattgtgtttggcaaactgagtagagtctcattgacaatgttagagttatttctagatactaagtgactggaaggattaatgagagtggatacatggaataattaattaccctttaatgagagtggataaatggaataataattaattaccctttacttggcaaggatcttctttctcctctctcccttcttttcactagtctttatagtcataagctcaaatgcagaagttaaataaaactgcaaatcaaatgtctcctgccgtgtgacatgctggggagactgagtccttagcttgtcactaattagttgcacagcttcaccaataagaacttggatattgtggtggcatcccagtgacagatgaatgatccttggagctacattgttagtgggttatttacagaattccttgcatcctagcaattcaagggttctgatgttgcaccctcctggaaacccagaacaaaaatctgaaggtctactttttaatcttcataccacccctttgaggtaggtagatgacatattgcccccattttgcagatgaggaaaactgaggcaccgagaggtggagtgatttgactgaggtcacagggtggtgagtttgtgtgacccaggttgcaaatacttacttcttcagtgattaaaaagaaaccaggactcccaaatccctagcctcttgcttttcccactccatagcttcctctctggacttgacaagtaagtgcgtcttaatggactctatatcttaagttcttcttggaaggcataattggggaggcctttgcatctcccaagaggaaggattttttttttcagttcccttcctcgttttgtcatcttaggctccaggctttcgtttgttgtttttgctttgctttctccttttactgtgttgactagattctttcatataacaaactacaaaatagcaccattgtactaaaaaacaacaacaacagagttttacatactgtttgatatttcctgtattattgatatactaactttacatagtgctctatatggaaaaaaataaaaaagagagaaactgctatacttaggttacatactaacttatcatttgaagaaaccattgagagtttaagagacgttctatgcttcaaacacacacctaaaaatgattggcctcaaagttgtagttattgttattctattttttttcttgaaacacaatgtcaaaaaaaataaagctttgtgtctaaaataaatgcattcaacttatatttggtacaaatgccacagatggagtcaggtacgttaaaacttggtaggccacttgactacttatttgctattgctcttaaggaggccaaattcaacaaatacaagtgttaggaaagggtgtgtctaatgcagctagacaagatgattagactctgtaaaacaagcagcttgagctacgtgggaagaggtgaagataagggaaccattcataaaccacctctacacagttgctaaatgaatggcttcagcagccaaaattcagagagaaacttagagcaactggatctctacaacatccatgcattttcggctctttagaggcagggactaggagatatagttatatatatattttttttctctatagaatgttattgataaaggaccaacagcaatctacccacgccaggaccacttttgcaaggtgcaaagctttttaaacaaacactcctaaagacgatgttggaatgtttacttgtatatttcattgggggaaatgcccatctttgtaatgttattggacttattattgttatttggtaggtgtttcgatgttttgcaggttgctcaagcagcaaaggatcctgcggtgatgtggcattttctgctccgtgggaggctcctcctacattctgtaggtcttgtttcctgcacttcctctacttgtgttcttcaaatgtacttcctttccttctcctttgcagcttcgttttcttgtttgtcgatagggacggggacttctgagtcttgggcatgtcagtgtggcgctgggcacggatagagcgggctgcttttgtaggcttcagtggggcacagtacatctccagtctcctcagatcacagctccggaagcaacactcatccacaatgcctgtctgaggtgccctccgaatgctggagccatagcctgtgggcttgttgaagtaaaagcccctcggtccacacacgaactgaagagcatccaccagctcagccccgcaaagggtctctggtccagctgtggtggagctggtgaaggtgagcaagcagagcgccaggtagaagaggtgtgaagacgacatgatgtgtatctttatcttcaagaagtcacagaggcagatcttaaataattgagttggaaggctgctgattttccccatcgcttctgaagtacaaagtctggaaatgaattggtgggcagggataatgaggcgaaaaagaaatccagagagatgggagatgttagagcaatgtcacatttcaattttgaggactttattccattgcgcaggctctatctgctctgaatttagcagtgacagtgagatttagcaagcagaagagggatttagagaaaatcctcacatttatctacaaaacacagacactgtagacaggaaacagctgggggaacattcgccttctctctctctccctcttctggcaaagttatcgagt

SEQ ID NO: 19 - DNA, 1879 bp, Rattus norvegicus
aagagggagagagagagaaggcgaatgttcccccagctgtttcctgtctacagtgtctgtgttttgtagataaatgtgaggattttctctaaatccctcttctgcttgctaaatctcactgtcgctgctaaattcagagcagatagagcctgcgcaatcgaaataaagtcctcaaaattgaaatgtgactttgctctaacatctcccatctctctggatttctttttgcctcattattcctgcccaccaattcatttccagactttgtacttcagaagcgatggggaaaatcagcagtcttccaactcaattatttaagatctgcctctgtgacttcttgaagataaagatacacatcatgtcgtcttcacatctcttctacctggcactctgcttgctcacctttaccagctcggccacagccggaccagagaccctttgcggggctgagctggtggacgctcttcagttcgtgtgtggaccaaggggcttttacttcaacaagcccacaggctatggctccagcattcggagggcaccacagacgggcattgtggatgagtgttgcttccggagctgtgatctgaggaggctggagatgtactgtgctccgctgaagcctacaaagtcagctcgttccatccgggcccagcgccacactgacatgcccaagactcagaagtcccagcccctatcgacacacaagaaaaggaagctgcaaaggagaaggaaaggaagtacacttgaagaacacaagtagaggaagtgcaggaaacaagacctacagaatgtaggaggagcctcccgaggaacagaaaatgccacgtcaccgcaagatcctttgctgcttgagcaacctgcaaaacatcggaacacctgccaaatatcaataatgagttcaataccatttcagagatgggcatttccctcaatgaaatacacaagtaaacattccgacattgtctttaggagtgtttgttaaaaaaaaaaaaaaaaaaaacaaaaacaaaaacaaaaaaaaaaagctttgcaccttgcaaaagtggtcctggcgtgggtagattgctgttaatcctttatcaataacgttctatagagaatatataaatatatatataattatatctcctagtccctgcctcttaagagccgaaaatgcatgggtgttgtagacattcggttgcactaaattcctctctgaattttggctgctgaagccgttcatttagcaactgtttataggtggttgatgaatggttccttatctccatttcttcctatgtagcttaagccgcttccttcacagaatctaataatctcgtctaggccattagccctgccctttcttaacattcttgtatttgttgaatttggcctcctcgaaagcaatagcaactgggtggcccacccaagttttaacgcccctgattccatctatggcatttgtaccaaatataagttggatgcatttattttagacacaaagctttattttttcgacatcgtgtttcaagaaaaaaaacaaatagaataacaataactatgactttgaggccaatcatttttaggtgtgtgtttgaagcatagaacgtctcttaaactctcaatggttccttcaaatgatgagttagtatgtaacgtaaatagcagtttctctctctctctctctctttttattttttccatatagagcactatgtaaatttagcatatcaataatacaggaactatcaaacagtatgtaaactccgttgttgttgtttttagtacaatggtgctattttgtagtttgttctatgaaagaatctagtcaacacagagaaaggagaaagcaaagcaaaaacaatgaaagcctggagcccaaaaggacaaaattagg

SEQ ID NO: 20 - DNA, 1879 bp, Rattus norvegicus
cctaattttgtccttttgggctccaggctttcattgtttttgctttgctttctcctttctctgtgttgactagattctttcatagaacaaactacaaaatagcaccattgtactaaaaacaacaacaacggagtttacatactgtttgatagttcctgtattattgatatgctaaatttacatagtgctctatatggaaaaaataaaaagagagagagagagagagaaactgctatttacgttacatactaactcatcatttgaaggaaccattgagagtttaagagacgttctatgcttcaaacacacacctaaaaatgattggcctcaaagtcatagttattgttattctatttgttttttttcttgaaacacgatgtcgaaaaaataaagctttgtgtctaaaataaatgcatccaacttatatttggtacaaatgccatagatggaatcaggggcgttaaaacttgggtgggccacccagttgctattgctttcgaggaggccaaattcaacaaatacaagaatgttaagaaagggcagggctaatggcctagacgagattattagattctgtgaaggaagcggcttaagctacataggaagaaatggagataaggaaccattcatcaaccacctataaacagttgctaaatgaacggcttcagcagccaaaattcagagaggaatttagtgcaaccgaatgtctacaacacccatgcattttcggctcttaagaggcagggactaggagatataattatatatatatttatatattctctatagaacgttattgataaaggattaacagcaatctacccacgccaggaccacttttgcaaggtgcaaagctttttttttttgtttttgtttttgttttttttttttttttttttaacaaacactcctaaagacaatgtcggaatgtttacttgtgtatttcattgagggaaatgcccatctctgaaatggtattgaactcattattgatatttggcaggtgttccgatgttttgcaggttgctcaagcagcaaaggatcttgcggtgacgtggcattttctgttcctcgggaggctcctcctacattctgtaggtcttgtttcctgcacttcctctacttgtgttcttcaagtgtacttcctttccttctcctttgcagcttccttttcttgtgtgtcgataggggctgggacttctgagtcttgggcatgtcagtgtggcgctgggcccggatggaacgagctgactttgtaggcttcagcggagcacagtacatctccagcctcctcagatcacagctccggaagcaacactcatccacaatgcccgtctgtggtgccctccgaatgctggagccatagcctgtgggcttgttgaagtaaaagccccttggtccacacacgaactgaagagcgtccaccagctcagccccgcaaagggtctctggtccggctgtggccgagctggtaaaggtgagcaagcagagtgccaggtagaagagatgtgaagacgacatgatgtgtatctttatcttcaagaagtcacagaggcagatcttaaataattgagttggaagactgctgattttccccatcgcttctgaagtacaaagtctggaaatgaattggtgggcaggaataatgaggcaaaaagaaatccagagagatgggagatgttagagcaaagtcacatttcaattttgaggactttatttcgattgcgcaggctctatctgctctgaatttagcagcgacagtgagatttagcaagcagaagagggatttagagaaaatcctcacatttatctacaaaacacagacactgtagacaggaaacagctgggggaacattcgccttctctctctctccctctt

SEQ ID NO: 21 - DNA, 7358 bp, Macaca fascicularis
ggcaaatgttcccccagctgtttcctgtctacagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcactgtgcctgctcaccttcaccagctccgccacggctggaccggagacgctctgcggggctgagctggtggatgctcttcagttcgtgtgtggagacaggggcttttatttcaacaagcccacagggtatggctccagcagtcggagggcacctcagacaggcatcgtggatgagtgctgcttccggagctgtgatctgagaaggctggagatgtattgcgcacccctcaagcctgccaagtcagcccgctctgtccgtgcccagcgccacaccgacatgcccaagacccagaaggaagtacatttgaagaacgcaagtagagggagtgcaggaaacaagaactacagaatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcctttatcaataatgttctatagaaaagaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaacacgggctgtttgttttacagtgtctgataatcttgttagtctatacccaccacctcccttcataacctttatatttgccgaatttggcctcctcaaaagcagcagcaagtcgtcaagaagcacaccaatttctaacccacaagattccatctgtggcatttgtaccaaatataagttggatgcattttattttagacacaaagctttatttttccacatcatgcttacaaaaaagaataatgcaaatagttgcaactttgaggccaatcattttcaggcatatattttaaacatagaaagtttcttcaactcaaaacagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaataggtgaaagcaaaacaataggggaagcctggagccaaagatgacacaaggggaagggtactgaaaacgccatccatttgggaaagaaggcaaagtccccataattatgccttccaagaggaacttcagacacaaaagtccactgatgcaaattggactggcaagtccagagaggaaactgtggaatggaaaaagcagaaggctaggaattttagcagtcctggtttctttttctcactgaagaaacaaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggtgcttgagttgctgagatgcaaggaattctataaataacccattcatagcatagctagagattggtgaattgaatgctcctgacatctcagttcttgtcagtgaaactatccaaataactggccaactaactagttgttaaaagctaacagctcaatctcttttaaaacactttttaaaatatgtgagaagcatgtgattttcaatttgattttgaattctgcatttggttttatgaatacaaagataagtgaaaagagagaaaggaaaagaaaaaaggagaaaaacaaagagatttctaccagtgaaaggggagttaattactctatttgttagcactcactgactcttctatgcagttactatatatctagtaaaaccttgtttaatactataaataatattctattcattttgaaaaacatgatacttccttcttttctaggcaatataaggaaaatgaccccaaatttgaaatattaaaataatatctaataaaaagtcacaaagttatcttctttaaaaaactttactcttattcttagctgtatatacattttttaaaaattgtgttaaaacttgcttgactagagttgccaattgaaaggcaaaaacttccatcaaaacaagaaatttcccatgcctgtttagaagggtagcccctagctctctgtgaatgtgttttatccattcagctgaaaattggtatcaagaaagtccactggttagtgtactagtccatcatagcctagaaaatgatccccatctgtagatcaagattttctcattagaacaatgagttatccaacattcagatctttttattcaccttaggactttttggttaaaagtacccaggcttaattatttcatgcaaattgtatattttacattcttggaaagtctatatgaaaaacaaaaagaacatcttcagtttttctcccactgggtcacctcaaggatcagaggccaggaaaaaaaagactccctggatctctgaatatctgcaaaaagaaggccgcatttagtggagccagcactcctgttcagtcaacaagtattttaactctcagtctaacattatttgaattgagcacctcaagcatgcttagcaatattccaatcactatggacagatgtaaaagaaactatacatcatttttgccctctacctgttttccagacatacaggttctgtggaataagatactggactcctcttcccaagatggcacttctttttatttcttgtccccagtgtgtaccttttaaaagtattccctctcaacaaaactttataggcagacttctgcagacttacgtgttttctgtcatagttagatgtgataattctgagactgtctatgacttatttccttcacttaattctatccacagtcaaaaatcccccaaggagaaaagctgaaagatgcattgccatattatctttcttaactttttccaacacataatcctccccaactggatcataaataaattgaaaataactcattataccaattcactattttattttttaatgaattaacactagaagacaaattgatgcaaaccctggaagtcagtcgattactatatactccagcagaatgactcggatttcatagaaaggagcaaacaaaatatcacaacccaacattttacaagctttgcttcagaattagattgctttataattcttgaatgaggccatttcaagatatttgtaaaagaatggtaaacattggtaggaatgagctttcaactcataggcttatttccaatttaattgaccatcctcgatacttaggtcaaatttctgttctctcttccccaaatagtatcaaagtattatttgaactttttaagatgaggtggttcccctgaaaagttaatgcagcgccgcatcagaatccactcttctagggatatgaaaatctctcaacacccaccctacatacacagacacagacgcagatacagacatacacacacagacacacacacacgttcaccctaaggatccaatgggatactgaaaagaaatcacttccttggaaattttattaaaaaacaaacaaacaaaagcctgtcttcccttgagaatccttcctgtccttggaacatcaatctttgtgtagatgaaaccatttcatgctctatggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagatggaaattttttaaagttagaaggctccattgttttgttggctctcaaacttagcaaaattagcaatatattatccaatcttctgaagttgatcaagagcatggagaataaatgtgggaaaaaagatcttacggccaaatagaagaacttaaaagataagtaagttccttattgatttttgtgctctctgctctaaaacagatactcagcaagtggagaaaataagaacaaagagaaaaaaatacatagatttacctgtaaaaaaaaaaaatagcttctgccaaatcccccttcggtattttttggcatttactggtttatagaagatattctcccttcacccagacatctcaaagagcagtagctctcatgaaaagcagtcactgatctcatttgggaaatgttggaaagtatttccttatgagatgggggttatctactgataaagaaagaatttatgagaaatcgttgaaagagatggctaacaatctgtgaagaattttttgtttcttgtttttgttttttttttttttttactttatacagtctttatgaatttcttaatactcaaaatgacttggttcttttcttctttttttatattggaatgaggaataataagttaaacccacatagactctttaaaactataggctagatagaaatgtatgtttgacttgttgaagctgtaatcagactatttaaaatgttttgctatttttaatcttaaaagattgtgctaatttattagagcagaacctgtttgactctcctcataagaaagaatctttccattcagatcacatgggctttccaccaatattttcaatagataaatctgatttatgcaatggcatcatttattttaaattagaagaattgtgaaactttatgcccctcccttgcaaagatcataaagtccagatctggtaggggggcagcaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttctttgtgtaatttctatttaaaaaagaaagaagactgtcagaagctttaagtgcatatggtacaggataaagatatcaatttaaataatcaatccctatctggaacaatgcttttgttttttaaagaaacctctcacagataagacagaggcccaggggatttttgaagctgtctttattctgcccccatcccaacccagtcattattttaatatcttcctcagaattttatagagggctgaccaagctgaaactctagaattaaaggaacctcattgaaaacatatatttcacgtgttccctctttttttttttttttttgagatggagtctcatactgtcccccaggctggagtgcagtggcacgatctcgggtcactgcaacctctgtctcctgagttcaagcgattctcctgctttagcctctcgagtagctgggattacaggcacccaccaccatgtccagctaattttttgtatttttagtagagacggggtttcaccatattggccaggttggtcttgaactcctgaccttgcgatttgcccacctcagcctcccaaagtgctgggattacaggcgtgagccaccacgccctgcccatgtgttccctcttaacgtatgattacattgatcgtaaacatggtccttctctcctcattcttcaactatctttgataggggtctttcaaggggaaaaaaatccaagcttttttaaaattaaaaaaaaaaaagagaggacacaaaaccaaatgttactgcccaactgaaatatgagttaagatggagatagagtttctcctgagaaactctgagttgaattacctgagctgaattagctgtcactttcaaaaacatgaccttccacaatccttagaatctgcctttttttaaatattactaaggcctaaaagtaagcattactcattttattttgcccaaaatgcactgatgtaaagtaggaaaaataaaaacagagctctaaaatccctttcaagccacccattgaccccactcaccaactcatagcaaagtcacttccgttaatcccttaatctgatttcgtttggatatttatcttgtacccgctgctaaacacaccacaggagggactctgaaacctcaagctgtctacttacatcttttatctgtgtctgtgtatcatgaaaatgtctcttcgaaatatcaaaacctttcaaatatcatgcagcttatattcagtttacataaaggccccaaataccatgtcagatctctttttggtaaaagagttaatgaactatgagaattgggattacatcatgtattttgcctcatgtatttttatcacacttataggccaagtgtgataaataaacttacagacactgaattaatttcccctgctactttgaaaccaggaaataatgactggccattcattatatctgtcttagttgaaaagcatattttttattaaattaattctgattgtatttgaaattattactcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattaca

SEQ ID NO: 22 - DNA, 7358 bp, Macaca fascicularis
tgtaattactaaagaaagatataccattttattatgacactctagccatacattttcaaaatatgcttattaaacagtaaatgtaagataatgattcaattagttacatttttagaagtcattaggattgatattcctctgccataagtgaattgagtaataatttcaaatacaatcagaattaatttaataaaaaatatgcttttcaactaagacagatataatgaatggccagtcattatttcctggtttcaaagtagcaggggaaattaattcagtgtctgtaagtttatttatcacacttggcctataagtgtgataaaaatacatgaggcaaaatacatgatgtaatcccaattctcatagttcattaactcttttaccaaaaagagatctgacatggtatttggggcctttatgtaaactgaatataagctgcatgatatttgaaaggttttgatatttcgaagagacattttcatgatacacagacacagataaaagatgtaagtagacagcttgaggtttcagagtccctcctgtggtgtgtttagcagcgggtacaagataaatatccaaacgaaatcagattaagggattaacggaagtgactttgctatgagttggtgagtggggtcaatgggtggcttgaaagggattttagagctctgtttttatttttcctactttacatcagtgcattttgggcaaaataaaatgagtaatgcttacttttaggccttagtaatatttaaaaaaaggcagattctaaggattgtggaaggtcatgtttttgaaagtgacagctaattcagctcaggtaattcaactcagagtttctcaggagaaactctatctccatcttaactcatatttcagttgggcagtaacatttggttttgtgtcctctcttttttttttttaattttaaaaaagcttggatttttttccccttgaaagacccctatcaaagatagttgaagaatgaggagagaaggaccatgtttacgatcaatgtaatcatacgttaagagggaacacatgggcagggcgtggtggctcacgcctgtaatcccagcactttgggaggctgaggtgggcaaatcgcaaggtcaggagttcaagaccaacctggccaatatggtgaaaccccgtctctactaaaaatacaaaaaattagctggacatggtggtgggtgcctgtaatcccagctactcgagaggctaaagcaggagaatcgcttgaactcaggagacagaggttgcagtgacccgagatcgtgccactgcactccagcctgggggacagtatgagactccatctcaaaaaaaaaaaaaaaaagagggaacacgtgaaatatatgttttcaatgaggttcctttaattctagagtttcagcttggtcagccctctataaaattctgaggaagatattaaaataatgactgggttgggatgggggcagaataaagacagcttcaaaaatcccctgggcctctgtcttatctgtgagaggtttctttaaaaaacaaaagcattgttccagatagggattgattatttaaattgatatctttatcctgtaccatatgcacttaaagcttctgacagtcttctttcttttttaaatagaaattacacaaagaaaagatatctatgtatcactttctaatacctaacaggaaggtcttataaaatattaaaatagcaataagcaaatatgtactacaggattaaacactagcattgaaaacaaaacaaaatccaaaaccaagaatcaacaacattttccttttgttgctgcccccctaccagatctggactttatgatctttgcaagggaggggcataaagtttcacaattcttctaatttaaaataaatgatgccattgcataaatcagatttatctattgaaaatattggtggaaagcccatgtgatctgaatggaaagattctttcttatgaggagagtcaaacaggttctgctctaataaattagcacaatcttttaagattaaaaatagcaaaacattttaaatagtctgattacagcttcaacaagtcaaacatacatttctatctagcctatagttttaaagagtctatgtgggtttaacttattattcctcattccaatataaaaaaagaagaaaagaaccaagtcattttgagtattaagaaattcataaagactgtataaagtaaaaaaaaaaaaaaaacaaaaacaagaaacaaaaaattcttcacagattgttagccatctctttcaacgatttctcataaattctttctttatcagtagataacccccatctcataaggaaatactttccaacatttcccaaatgagatcagtgactgcttttcatgagagctactgctctttgagatgtctgggtgaagggagaatatcttctataaaccagtaaatgccaaaaaataccgaagggggatttggcagaagctattttttttttttacaggtaaatctatgtatttttttctctttgttcttattttctccacttgctgagtatctgttttagagcagagagcacaaaaatcaataaggaacttacttatcttttaagttcttctatttggccgtaagatcttttttcccacatttattctccatgctcttgatcaacttcagaagattggataatatattgctaattttgctaagtttgagagccaacaaaacaatggagccttctaactttaaaaaatttccatctcctgcccctgcacccccaaattcacaatttggtgaacagtacactacttgtgagtgataaaaagttgaaaggtggtggtggctagatagacctaatgctattttattaagccatctatctatagaattgttgtttttatactttaaaaaaatatgtctatgctttcttttttttctttttttctttttttttttttagtcaagtactttcttaaagaaacaatagcaccacattggcatagctggccaaacaataaatgggaaagcaaaatgtgctacatcttttattctaagccttctcccaagtgcataaaatagtaacagaaaccctggagccatagagcatgaaatggtttcatctacacaaagattgatgttccaaggacaggaaggattctcaagggaagacaggcttttgtttgtttgttttttaataaaatttccaaggaagtgatttcttttcagtatcccattggatccttagggtgaacgtgtgtgtgtgtctgtgtgtgtatgtctgtatctgcgtctgtgtctgtgtatgtagggtgggtgttgagagattttcatatccctagaagagtggattctgatgcggcgctgcattaacttttcaggggaaccacctcatcttaaaaagttcaaataatactttgatactatttggggaagagagaacagaaatttgacctaagtatcgaggatggtcaattaaattggaaataagcctatgagttgaaagctcattcctaccaatgtttaccattcttttacaaatatcttgaaatggcctcattcaagaattataaagcaatctaattctgaagcaaagcttgtaaaatgttgggttgtgatattttgtttgctcctttctatgaaatccgagtcattctgctggagtatatagtaatcgactgacttccagggtttgcatcaatttgtcttctagtgttaattcattaaaaaataaaatagtgaattggtataatgagttattttcaatttatttatgatccagttggggaggattatgtgttggaaaaagttaagaaagataatatggcaatgcatctttcagcttttctccttgggggatttttgactgtggatagaattaagtgaaggaaataagtcatagacagtctcagaattatcacatctaactatgacagaaaacacgtaagtctgcagaagtctgcctataaagttttgttgagagggaatacttttaaaaggtacacactggggacaagaaataaaaagaagtgccatcttgggaagaggagtccagtatcttattccacagaacctgtatgtctggaaaacaggtagagggcaaaaatgatgtatagtttcttttacatctgtccatagtgattggaatattgctaagcatgcttgaggtgctcaattcaaataatgttagactgagagttaaaatacttgttgactgaacaggagtgctggctccactaaatgcggccttctttttgcagatattcagagatccagggagtcttttttttcctggcctctgatccttgaggtgacccagtgggagaaaaactgaagatgttctttttgtttttcatatagactttccaagaatgtaaaatatacaatttgcatgaaataattaagcctgggtacttttaaccaaaaagtcctaaggtgaataaaaagatctgaatgttggataactcattgttctaatgagaaaatcttgatctacagatggggatcattttctaggctatgatggactagtacactaaccagtggactttcttgataccaattttcagctgaatggataaaacacattcacagagagctaggggctacccttctaaacaggcatgggaaatttcttgttttgatggaagtttttgcctttcaattggcaactctagtcaagcaagttttaacacaatttttaaaaaatgtatatacagctaagaataagagtaaagttttttaaagaagataactttgtgactttttattagatattattttaatatttcaaatttggggtcattttccttatattgcctagaaaagaaggaagtatcatgtttttcaaaatgaatagaatattatttatagtattaaacaaggttttactagatatatagtaactgcatagaagagtcagtgagtgctaacaaatagagtaattaactcccctttcactggtagaaatctctttgtttttctccttttttcttttcctttctctcttttcacttatctttgtattcataaaaccaaatgcagaattcaaaatcaaattgaaaatcacatgcttctcacatattttaaaaagtgttttaaaagagattgagctgttagcttttaacaactagttagttggccagttatttggatagtttcactgacaagaactgagatgtcaggagcattcaattcaccaatctctagctatgctatgaatgggttatttatagaattccttgcatctcagcaactcaagcaccctgatgttgcacccttacagcaacccagggtaaaaaaaatctgaatctttatctttttaaaccttataccacccctttgaggtaggtagatgacatattgcccccattttgcagatgaggaaactgaggcacagagaggtgaagtgacttgcccaaggtcacacagtggtgagtccatgacacagctggcagatgtttgtttcttcagtgagaaaaagaaaccaggactgctaaaattcctagccttctgctttttccattccacagtttcctctctggacttgccagtccaatttgcatcagtggacttttgtgtctgaagttcctcttggaaggcataattatggggactttgccttctttcccaaatggatggcgttttcagtacccttccccttgtgtcatctttggctccaggcttcccctattgttttgctttcacctattaccgttttggccagactctttcatataacaaactacaaaatagcaccattatactaaaaaacagagttttacatactgtttgatatatcctgtataattgatatgctaaatttacatagtgctctatatggaaaaaataaaaagaggaaagttactaattaggttgcacattaactcatcatttgaaggaactgttttgagttgaagaaactttctatgtttaaaatatatgcctgaaaatgattggcctcaaagttgcaactatttgcattattcttttttgtaagcatgatgtggaaaaataaagctttgtgtctaaaataaaatgcatccaacttatatttggtacaaatgccacagatggaatcttgtgggttagaaattggtgtgcttcttgacgacttgctgctgcttttgaggaggccaaattcggcaaatataaaggttatgaagggaggtggtgggtatagactaacaagattatcagacactgtaaaacaaacagcccgtgttgtgtagaaagaagtgcaaataaggaaacaattcataaaccacttagacaaggttgctgaatgaatggctccagcagccaagattcagagaggaatttagtgcaactggatctatacaacacccatgcatttgtggctcttgagaggcagggactaagatatatatatatatatattttcttttctatagaacattattgataaaggatcaacagcaatctaccaactccaggaccatttttgcaaggtgcaaatcactcctaaagacaatgttggaatgtttacttgtgtatttcattgggggaaacgcccatcttttaaatgttatcaaacttattttttggtaggtgttccaaagtttaacaggtaactcgtgcagagcaaaggatcctgcggtggcatgtcactcttcactcctcaggagggtcttcctacattctgtagttcttgtttcctgcactccctctacttgcgttcttcaaatgtacttccttctgggtcttgggcatgtcggtgtggcgctgggcacggacagagcgggctgacttggcaggcttgaggggtgcgcaatacatctccagccttctcagatcacagctccggaagcagcactcatccacgatgcctgtctgaggtgccctccgactgctggagccataccctgtgggcttgttgaaataaaagcccctgtctccacacacgaactgaagagcatccaccagctcagccccgcagagcgtctccggtccagccgtggcggagctggtgaaggtgagcaggcacagtgccaggtagaagagatgcgaggaggacatggtgtgcatcttcaccttcaagaaatcacaaaagcagcacttaaataattgggttggaagactgctgatttttcccattgcttctgaagtacaaagtctgaaaatgaattggttagcaggaataatgaagcaaaaagaaatccagagagatgggagatgttgagagcaatgtcacatttcaattttgaggactttattccattgcgcaggctctatctgctctgaatttagcagtgacagtgagatttagcaaacagaagagggatttagagaaaatcctcacatttatctacaaaacacagacactgtagacaggaaacagctgggggaacatttgcc

SEQ ID NO: 23 - DNA, 2099 bp, Homo sapiens
ctcgagggaaatccagagggcaggggtggccggcacagcagacgtaccctccctcgctgcctgcctgcagcctgccctgcatgcaggatggccctgaggaaaggaggcctggccctggcgctgctgctgctgtcctgggtggcactgggcccccgcagcctggagggagcagaccccggaacgccgggggaagccgagggcccagcgtgcccggccgcctgtgtctgcagctacgatgacgacgcggatgagctcagcgtcttctgcagctccaggaacctcacgcgcctgcctgatggagtcccgggcggcacccaagccctgtggctggacggcaacaacctctcgtccgtccccccggcagccttccagaacctctccagcctgggcttcctcaacctgcagggcggccagctgggcagcctggagccacaggcgctgctgggcctagagaacctgtgccacctgcacctggagcggaaccagctgcgcagcctggcactcggcacgtttgcacacacgcccgcgctggcctcgctcggcctcagcaacaaccgtctgagcaggctggaggacgggctcttcgagggcctcggcagcctctgggacctcaacctcggctggaatagcctggcggtgctccccgatgcggcgttccgcggcctgggcagcctgcgcgagctggtgctggcgggcaacaggctggcctacctgcagcccgcgctcttcagcggcctggccgagctccgggagctggacctgagcaggaacgcgctgcgggccatcaaggcaaacgtgttcgtgcagctgccccggctccagaaactctacctggaccgcaacctcatcgctgccgtggccccgggcgccttcctgggcctgaaggcgctgcgatggctggacctgtcccacaaccgcgtggctggcctcctggaggacacgttccccggtctgctgggcctgcgtgtgctgcggctgtcccacaacgccatcgccagcctgcggccccgcaccttcaaggacctgcacttcctggaggagctgcagctgggccacaaccgcatccggcagctggctgagcgcagctttgagggcctggggcagcttgaggtgctcacgctagaccacaaccagctccaggaggtcaaggcgggcgctttcctcggcctcaccaacgtggcggtcatgaacctctctgggaactgtctccggaaccttccggagcaggtgttccggggcctgggcaagctgcacagcctgcacctggagggcagctgcctgggacgcatccgcccgcacaccttcaccggcctctcggggctccgccgactcttcctcaaggacaacggcctcgtgggcattgaggagcagagcctgtgggggctggcggagctgctggagctcgacctgacctccaaccagctcacgcacctgccccaccgcctcttccagggcctgggcaagctggagtacctgctgctctcccgcaaccgcctggcagagctgccggcggacgccctgggccccctgcagcgggccttctggctggacgtctcgcacaaccgcctggaggcattgcccaacagcctcttggcaccactggggcggctgcgctacctcagcctcaggaacaactcactgcggaccttcacgccgcagcccccgggcctggagcgcctgtggctggagggtaacccctgggactgtggctgccctctcaaggcgctgcgggacttcgccctgcagaaccccagtgctgtgccccgcttcgtccaggccatctgtgagggggacgattgccagccgcccgcgtacacctacaacaacatcacctgtgccagcccgcccgaggtcgtggggctcgacctgcgggacctcagcgaggcccactttgctccctgctgaccaggtccccggactcaagccccggactcaggcccccacctggctcaccttgtgctggggacaggtcctcagtgtcctcaggggcctgcccagtgcacttgctggaagacgcaagggcctgatggggtggaaggcatggcggcccccccagctgtcatcaattaaaggcaaaggcaatcgaatctagcggccgc

SEQ ID NO: 24 - protein, 16 aa, Unknown
  source: /note="Description of Unknown: RFGF peptide"
AAVALLPAVLLALLAP

SEQ ID NO: 25 - protein, 11 aa, Unknown
  source: /note="Description of Unknown: RFGF analogue peptide"
AALLPVLLAAP

SEQ ID NO: 26 - protein, 13 aa, Human immunodeficiency virus
GRKKRRQRRRPPQ

SEQ ID NO: 27 - protein, 16 aa, Drosophila sp.
RQIKIWFQNRRMKWKK

SEQ ID NO: 28 - RNA, 21 nt, Artificial Sequence
  source: /note="Description of Artificial Sequence: Synthetic oligonucleotide"
acagaugagcucagcgucuuu

SEQ ID NO: 29 - RNA, 21 nt, Artificial Sequence
  source: /note="Description of Artificial Sequence: Synthetic oligonucleotide"
agcucagcgucuuuugcaguu

SEQ ID NO: 30 - RNA, 21 nt, Artificial Sequence
  source: /note="Description of Artificial Sequence: Synthetic oligonucleotide"
cuguggcuggacggcaacaaa

SEQ ID NO: 31 - RNA, 21 nt, Artificial Sequence
  source: /note="Description of Artificial Sequence: Synthetic oligonucleotide"
ggacggcaacaaccucucgua

SEQ ID NO: 32 - RNA, 21 nt, Artificial Sequence
  source: /note="Description of Artificial Sequence: Synthetic oligonucleotide"
aaccgucugagcaggcuggaa

SEQ ID NO: 33 - RNA, 21 nt, Artificial Sequence
  source: /note="Description of Artificial Sequence: Synthetic oligonucleotide"
ggaccucaaccuggguuggaa

SEQ ID NO: 34 - RNA, 21 nt, Artificial Sequence
  source: /note="Description of Artificial Sequence: Synthetic oligonucleotide"
uggcaacaaacugacuuaccu

SEQ ID NO: 35 - RNA, 21 nt, Artificial Sequence
  source: /note="Description of Artificial Sequence: Synthetic oligonucleotide"
ggugcuggcgggcaacaggcu

SEQ ID NO: 36 - RNA, 21 nt, Artificial Sequence
  source: /note="Description of Artificial Sequence: Synthetic oligonucleotide"
gcuggaccugagcaggaacga

SEQ ID NO: 37 - RNA, 21 nt, Artificial Sequence
  source: /note="Description of Artificial Sequence: Synthetic oligonucleotide"
cuggaccugagcaggaacgca

SEQ ID NO: 38 - RNA, 21 nt, Artificial Sequence
  source: /note="Description of Artificial Sequence: Synthetic oligonucleotide"
ggccaucaaggcaaacguguu

SEQ ID NO: 39 - RNA, 21 nt, Artificial Sequence
  source: /note="Description of Artificial Sequence: Synthetic oligonucleotide"
gcaaccucaucgcugccguga

SEQ ID NO: 40 - RNA, 21 nt, Artificial Sequence
  source: /note="Description of Artificial Sequence: Synthetic oligonucleotide"
gcugccguggccccgggcgca

SEQ ID NO: 41 - RNA, 21 nt, Artificial Sequence
  source: /note="Description of Artificial Sequence: Synthetic oligonucleotide"
uggccccgggcgccuuccuga

SEQ ID NO: 42 - RNA, 21 nt, Artificial Sequence
  source: /note="Description of Artificial Sequence: Synthetic oligonucleotide"
gggccugaaggcgcugcgaua

SEQ ID NO: 43 - RNA, 21 nt, Artificial Sequence
  source: /note="Description of Artificial Sequence: Synthetic oligonucleotide"
gcguggcuggccuccuggaga

SEQ ID NO: 44 - RNA, 21 nt, Artificial Sequence
  source: /note="Description of Artificial Sequence: Synthetic oligonucleotide"
ggccuccuggaggacacguua

SEQ ID NO: 45 - RNA, 21 nt, Artificial Sequence
  source: /note="Description of Artificial Sequence: Synthetic oligonucleotide"
ugggccacaaccgcauccgga

SEQ ID NO: 46 - RNA, 21 nt, Artificial Sequence
  source: /note="Description of Artificial Sequence: Synthetic oligonucleotide"
ccacaaccgcauccggcagcu

SEQ ID NO: 47 - RNA, 21 nt, Artificial Sequence
  source: /note="Description of Artificial Sequence: Synthetic oligonucleotide"
agcuggcugagcgcagcuuua

SEQ ID NO: 48 - RNA, 21 nt, Artificial Sequence
  source: /note="Description of Artificial Sequence: Synthetic oligonucleotide"
cucacgcuagaccacaaccaa

SEQ ID NO: 49 - RNA, 21 nt, Artificial Sequence
  source: /note="Description of Artificial Sequence: Synthetic oligonucleotide"
ccucaccaacguggcggucau

SEQ ID NO: 50 - RNA, 21 nt, Artificial Sequence
  source: /note="Description of Artificial Sequence: Synthetic oligonucleotide"
ccucaccaacguggcggucau

SEQ ID NO: 51 - RNA, 21 nt, Artificial Sequence
  source: /note="Description of Artificial Sequence: Synthetic oligonucleotide"
caccaacguggcggucaugaa

SEQ ID NO: 52 - RNA, 21 nt, Artificial Sequence
  source: /note="Description of Artificial Sequence: Synthetic oligonucleotide"
accaacguggcggucaugaaa

SEQ ID NO: 53 - RNA, 21 nt, Artificial Sequence
  source: /note="Description of Artificial Sequence: Synthetic oligonucleotide"
ucaugaaccucucugggaacu

SEQ ID NO: 54 - RNA, 21 nt, Artificial Sequence
  source: /note="Description of Artificial Sequence: Synthetic oligonucleotide"
accucucugggaacugucuca

SEQ ID NO: 55 - RNA, 21 nt, Artificial Sequence
  source: /note="Description of Artificial Sequence: Synthetic oligonucleotide"
cucucugggaacugucuccga

SEQ ID NO: 56 - RNA, 21 nt, Artificial Sequence
  source: /note="Description of Artificial Sequence: Synthetic oligonucleotide"
gaacugucuccggaaccuuca

SEQ ID NO: 57 - RNA, 21 nt, Artificial Sequence
  source: /note="Description of Artificial Sequence: Synthetic oligonucleotide"
ggaacugucuccggaaccuua

SEQ ID NO: 58 - RNA, 21 nt, Artificial Sequence
  source: /note="Description of Artificial Sequence: Synthetic oligonucleotide"
cugucuccggaaccuuccgga

SEQ ID NO: 59 - RNA, 21 nt, Artificial Sequence
  source: /note="Description of Artificial Sequence: Synthetic oligonucleotide"
gucuccggaaccuuccggaga

SEQ ID NO: 60 - RNA, 21 nt, Artificial Sequence
  source: /note="Description of Artificial Sequence: Synthetic oligonucleotide"
cggaaccuuccggagcaggua

SEQ ID NO: 61 - RNA, 21 nt, Artificial Sequence
  source: /note="Description of Artificial Sequence: Synthetic oligonucleotide"
aaccuuccggagcagguguua

SEQ ID NO: 62 - RNA, 21 nt, Artificial Sequence
  source: /note="Description of Artificial Sequence: Synthetic oligonucleotide"
cuuccggagcagguguuccga

SEQ ID NO: 63 - RNA, 21 nt, Artificial Sequence
  source: /note="Description of Artificial Sequence: Synthetic oligonucleotide"
caucuccagcaucgaagaaca

SEQ ID NO: 64 - RNA, 21 nt, Artificial Sequence
  source: /note="Description of Artificial Sequence: Synthetic oligonucleotide"
cuccagcaucgaagaacagaa

SEQ ID NO: 65 - RNA, 21 nt, Artificial Sequence
  source: /note="Description of Artificial Sequence: Synthetic oligonucleotide"
cagcaucgaagaacagagccu

SEQ ID NO: 66 - RNA, 21 nt, Artificial Sequence
  source: /note="Description of Artificial Sequence: Synthetic oligonucleotide"
uuccucaaggacaacggccua

SEQ ID NO: 67 - RNA, 21 nt, Artificial Sequence
  source: /note="Description of Artificial Sequence: Synthetic oligonucleotide"
aaggacaacggccucguggga

SEQ ID NO: 68 - RNA, 21 nt, Artificial Sequence
  source: /note="Description of Artificial Sequence: Synthetic oligonucleotide"
gcugcuggagcucgaccugaa

SEQ ID NO: 69 - RNA, 21 nt, Artificial Sequence
  source: /note="Description of Artificial Sequence: Synthetic oligonucleotide"
ugaccuccaaccagcucacga

SEQ ID NO: 70 - RNA, 21 nt, Artificial Sequence
  source: /note="Description of Artificial Sequence: Synthetic oligonucleotide"
caaccagcucacgcaccugca

SEQ ID NO: 71 - RNA, 21 nt, Artificial Sequence
  source: /note="Description of Artificial Sequence: Synthetic oligonucleotide"
uggaguaccugcugcucucca

SEQ ID NO: 72 - RNA, 21 nt, Artificial Sequence
  source: /note="Description of Artificial Sequence: Synthetic oligonucleotide"
ugcagcgggccuucuggcuga

SEQ ID NO: 73 - RNA, 21 nt, Artificial Sequence
  source: /note="Description of Artificial Sequence: Synthetic oligonucleotide"
gcagcgggccuucuggcugga

SEQ ID NO: 74 - RNA, 21 nt, Artificial Sequence
  source: /note="Description of Artificial Sequence: Synthetic oligonucleotide"
uucuggcuggacgucucgcaa

SEQ ID NO: 75 - RNA, 21 nt, Artificial Sequence
  source: /note="Description of Artificial Sequence: Synthetic oligonucleotide"
ggcuggacgucucgcacaaca

SEQ ID NO: 76 - RNA, 21 nt, Artificial Sequence
  source: /note="Description of Artificial Sequence: Synthetic oligonucleotide"
ucaggaauaacuccuugcaga

SEQ ID NO: 77 - RNA, 21 nt, Artificial Sequence
  source: /note="Description of Artificial Sequence: Synthetic oligonucleotide"
ucagccucaggaacaacucaa

SEQ ID NO: 78 - RNA, 21 nt, Artificial Sequence
  source: /note="Description of Artificial Sequence: Synthetic oligonucleotide"
cagccucaggaacaacucacu

SEQ ID NO: 79 - RNA, 21 nt, Artificial Sequence
  source: /note="Description of Artificial Sequence: Synthetic oligonucleotide"
agccucaggaacaacucacua

SEQ ID NO: 80 - RNA, 21 nt, Artificial Sequence
  source: /note="Description of Artificial Sequence: Synthetic oligonucleotide"
uccaggccaucugugagggga

SEQ ID NO: 81 - RNA, 21 nt, Artificial Sequence
  source: /note="Description of Artificial Sequence: Synthetic oligonucleotide"
ggggacagguccucaguguca

SEQ ID NO: 82 - RNA, 21 nt, Artificial Sequence
  source: /note="Description of Artificial Sequence: Synthetic oligonucleotide"
ugucaucaauuaaaggcaaaa

SEQ ID NO: 83 - RNA, 21 nt, Artificial Sequence
  source: /note="Description of Artificial Sequence: Synthetic oligonucleotide"
ucaauuaaaggcaaaggcaau

SEQ ID NO: 84 - RNA, 21 nt, Artificial Sequence
  source: /note="Description of Artificial Sequence: Synthetic oligonucleotide"
aaaggcaaaggcaaucgaaua

SEQ ID NO: 85 - RNA, 23 nt, Artificial Sequence
  source: /note="Description of Artificial Sequence: Synthetic oligonucleotide"
aaagacgcugagcucaucugugu

SEQ ID NO: 86 - RNA, 23 nt, Artificial Sequence
  source: /note="Description of Artificial Sequence: Synthetic oligonucleotide"
aacugcaaaagacgcugagcuca

SEQ ID NO: 87 - RNA, 23 nt, Artificial Sequence
  source: /note="Description of Artificial Sequence: Synthetic oligonucleotide"
uuuguugccguccagccacaggg

SEQ ID NO: 88 - RNA, 23 nt, Artificial Sequence
  source: /note="Description of Artificial Sequence: Synthetic oligonucleotide"
uacgagagguuguugccguccag

SEQ ID NO: 89 - RNA, 23 nt, Artificial Sequence
  source: /note="Description of Artificial Sequence: Synthetic oligonucleotide"
uuccagccugcucagacgguugu

SEQ ID NO: 90 - RNA, 23 nt, Artificial Sequence
  source: /note="Description of Artificial Sequence: Synthetic oligonucleotide"
uuccaacccagguugagguccca

SEQ ID NO: 91 - RNA, 23 nt, Artificial Sequence
  source: /note="Description of Artificial Sequence: Synthetic oligonucleotide"
agguaagucaguuuguugccagc

SEQ ID NO: 92 - RNA, 23 nt, Artificial Sequence
  source: /note="Description of Artificial Sequence: Synthetic oligonucleotide"
agccuguugcccgccagcaccag

SEQ ID NO: 93 - RNA, 23 nt, Artificial Sequence
  source: /note="Description of Artificial Sequence: Synthetic oligonucleotide"
ucguuccugcucagguccagcuc

SEQ ID NO: 94 - RNA, 23 nt, Artificial Sequence
  source: /note="Description of Artificial Sequence: Synthetic oligonucleotide"
ugcguuccugcucagguccagcu

SEQ ID NO: 95 - RNA, 23 nt, Artificial Sequence
  source: /note="Description of Artificial Sequence: Synthetic oligonucleotide"
aacacguuugccuugauggcccg

SEQ ID NO: 96 - RNA, 23 nt, Artificial Sequence
  source: /note="Description of Artificial Sequence: Synthetic oligonucleotide"
ucacggcagcgaugagguugcgg

SEQ ID NO: 97 - RNA, 23 nt, Artificial Sequence
  source: /note="Description of Artificial Sequence: Synthetic oligonucleotide"
ugcgcccggggccacggcagcga

SEQ ID NO: 98 - RNA, 23 nt, Artificial Sequence
  source: /note="Description of Artificial Sequence: Synthetic oligonucleotide"
ucaggaaggcgcccggggccacg

SEQ ID NO: 99 - RNA, 23 nt, Artificial Sequence
  source: /note="Description of Artificial Sequence: Synthetic oligonucleotide"
uaucgcagcgccuucaggcccag

SEQ ID NO: 100 - RNA, 23 nt, Artificial Sequence
  source: /note="Description of Artificial Sequence: Synthetic oligonucleotide"
ucuccaggaggccagccacgcgg

SEQ ID NO: 101 - RNA, 23 nt, Artificial Sequence
  source: /note="Description of Artificial Sequence: Synthetic oligonucleotide"
uaacguguccuccaggaggccag

SEQ ID NO: 102 - RNA, 23 nt, Artificial Sequence
  source: /note="Description of Artificial Sequence: Synthetic oligonucleotide"
uccggaugcgguuguggcccagc

SEQ ID NO: 103 - RNA, 23 nt, Artificial Sequence
  source: /note="Description of Artificial Sequence: Synthetic oligonucleotide"
agcugccggaugcgguuguggcc

SEQ ID NO: 104 - RNA, 23 nt, Artificial Sequence
  source: /note="Description of Artificial Sequence: Synthetic oligonucleotide"
uaaagcugcgcucagccagcugc

SEQ ID NO: 105 - RNA, 23 nt, Artificial Sequence
  source: /note="Description of Artificial Sequence: Synthetic oligonucleotide"
uugguuguggucuagcgugagca

SEQ ID NO: 106 - RNA, 23 nt, Artificial Sequence
  source: /note="Description of Artificial Sequence: Synthetic oligonucleotide"
augaccgccacguuggugaggcc

SEQ ID NO: 107 - RNA, 23 nt, Artificial Sequence
  source: /note="Description of Artificial Sequence: Synthetic oligonucleotide"
augaccgccacguuggugaggcc

SEQ ID NO: 108 - RNA, 23 nt, Artificial Sequence
  source: /note="Description of Artificial Sequence: Synthetic oligonucleotide"
uucaugaccgccacguuggugag

SEQ ID NO: 109 - RNA, 23 nt, Artificial Sequence
  source: /note="Description of Artificial Sequence: Synthetic oligonucleotide"
uuucaugaccgccacguugguga

SEQ ID NO: 110 - RNA, 23 nt, Artificial Sequence
  source: /note="Description of Artificial Sequence: Synthetic oligonucleotide"
aguucccagagagguucaugacc

SEQ ID NO: 111 - RNA, 23 nt, Artificial Sequence
  source: /note="Description of Artificial Sequence: Synthetic oligonucleotide"
ugagacaguucccagagagguuc

SEQ ID NO: 112 - RNA, 23 nt, Artificial Sequence
  source: /note="Description of Artificial Sequence: Synthetic oligonucleotide"
ucggagacaguucccagagaggu

SEQ ID NO: 113 - RNA, 23 nt, Artificial Sequence
  source: /note="Description of Artificial Sequence: Synthetic oligonucleotide"
ugaagguuccggagacaguuccc

SEQ ID NO: 114 - RNA, 23 nt, Artificial Sequence
  source: /note="Description of Artificial Sequence: Synthetic oligonucleotide"
uaagguuccggagacaguuccca

SEQ ID NO: 115 - RNA, 23 nt, Artificial Sequence
  source: /note="Description of Artificial Sequence: Synthetic oligonucleotide"
uccggaagguuccggagacaguu

SEQ ID NO: 116 - RNA, 23 nt, Artificial Sequence
  source: /note="Description of Artificial Sequence: Synthetic oligonucleotide"
ucuccggaagguuccggagacag

SEQ ID NO: 117 - RNA, 23 nt, Artificial Sequence
  source: /note="Description of Artificial Sequence: Synthetic oligonucleotide"
uaccugcuccggaagguuccgga

SEQ ID NO: 118 - RNA, 23 nt, Artificial Sequence
  source: /note="Description of Artificial Sequence: Synthetic oligonucleotide"
uaacaccugcuccggaagguucc

SEQ ID NO: 119 - RNA, 23 nt, Artificial Sequence
  source: /note="Description of Artificial Sequence: Synthetic oligonucleotide"
ucggaacaccugcuccggaaggu

SEQ ID NO: 120 - RNA, 23 nt, Artificial Sequence
  source: /note="Description of Artificial Sequence: Synthetic oligonucleotide"
uguucuucgaugcuggagaugcu

SEQ ID NO: 121 - RNA, 23 nt, Artificial Sequence
  source: /note="Description of Artificial Sequence: Synthetic oligonucleotide"
uucuguucuucgaugcuggagau

SEQ ID NO: 122 - RNA, 23 nt, Artificial Sequence
  source: /note="Description of Artificial Sequence: Synthetic oligonucleotide"
aggcucuguucuucgaugcugga

SEQ ID NO: 123 - RNA, 23 nt, Artificial Sequence
  source: /note="Description of Artificial Sequence: Synthetic oligonucleotide"
uaggccguuguccuugaggaaga

SEQ ID NO: 124 - RNA, 23 nt, Artificial Sequence
  source: /note="Description of Artificial Sequence: Synthetic oligonucleotide"
ucccacgaggccguuguccuuga

SEQ ID NO: 125 - RNA, 23 nt, Artificial Sequence
  source: /note="Description of Artificial Sequence: Synthetic oligonucleotide"
uucaggucgagcuccagcagcuc

SEQ ID NO: 126 - RNA, 23 nt, Artificial Sequence
  source: /note="Description of Artificial Sequence: Synthetic oligonucleotide"
ucgugagcugguuggaggucagg

SEQ ID NO: 127 - RNA, 23 nt, Artificial Sequence
  source: /note="Description of Artificial Sequence: Synthetic oligonucleotide"
ugcaggugcgugagcugguugga

SEQ ID NO: 128 - RNA, 23 nt, Artificial Sequence
  source: /note="Description of Artificial Sequence: Synthetic oligonucleotide"
uggagagcagcagguacuccagc

SEQ ID NO: 129 - RNA, 23 nt, Artificial Sequence
  source: /note="Description of Artificial Sequence: Synthetic oligonucleotide"
ucagccagaaggcccgcugcagg

SEQ ID NO: 130 - RNA, 23 nt, Artificial Sequence
  source: /note="Description of Artificial Sequence: Synthetic oligonucleotide"
uccagccagaaggcccgcugcag

SEQ ID NO: 131 - RNA, 23 nt, Artificial Sequence
  source: /note="Description of Artificial Sequence: Synthetic oligonucleotide"
uugcgagacguccagccagaagg

SEQ ID NO: 132 - RNA, 23 nt, Artificial Sequence
  source: /note="Description of Artificial Sequence: Synthetic oligonucleotide"
uguugugcgagacguccagccag

SEQ ID NO: 133 - RNA, 23 nt, Artificial Sequence
  source: /note="Description of Artificial Sequence: Synthetic oligonucleotide"
ucugcaaggaguuauuccugagg

SEQ ID NO: 134 - RNA, 23 nt, Artificial Sequence
  source: /note="Description of Artificial Sequence: Synthetic oligonucleotide"
uugaguuguuccugaggcugagg

SEQ ID NO: 135 - RNA, 23 nt, Artificial Sequence
  source: /note="Description of Artificial Sequence: Synthetic oligonucleotide"
agugaguuguuccugaggcugag

SEQ ID NO: 136 - RNA, 23 nt, Artificial Sequence
  source: /note="Description of Artificial Sequence: Synthetic oligonucleotide"
uagugaguuguuccugaggcuga

SEQ ID NO: 137 - RNA, 23 nt, Artificial Sequence
  source: /note="Description of Artificial Sequence: Synthetic oligonucleotide"
uccccucacagauggccuggacg

SEQ ID NO: 138 - RNA, 23 nt, Artificial Sequence
  source: /note="Description of Artificial Sequence: Synthetic oligonucleotide"
ugacacugaggaccuguccccag

SEQ ID NO: 139 - RNA, 23 nt, Artificial Sequence
  source: /note="Description of Artificial Sequence: Synthetic oligonucleotide"
uuuugccuuuaauugaugacagc

SEQ ID NO: 140 - RNA, 23 nt, Artificial Sequence
  source: /note="Description of Artificial Sequence: Synthetic oligonucleotide"
auugccuuugccuuuaauugaug

SEQ ID NO: 141 - RNA, 23 nt, Artificial Sequence
  source: /note="Description of Artificial Sequence: Synthetic oligonucleotide"
uauucgauugccuuugccuuuaa

SEQ ID NO: 142 - RNA, 21 nt, Artificial Sequence
  source: /note="Description of Artificial Sequence: Synthetic oligonucleotide"
cuguggcuggacggcaacaaa

SEQ ID NO: 143 - RNA, 21 nt, Artificial Sequence
  source: /note="Description of Artificial Sequence: Synthetic oligonucleotide"
ggacggcaacaaccucucgua

SEQ ID NO: 144 - RNA, 21 nt, Artificial Sequence
  source: /note="Description of Artificial Sequence: Synthetic oligonucleotide"
aaccgucugagcaggcuggaa

SEQ ID NO: 145 - RNA, 21 nt, Artificial Sequence
  source: /note="Description of Artificial Sequence: Synthetic oligonucleotide"
ggugcuggcgggcaacaggcu

SEQ ID NO: 146 - RNA, 21 nt, Artificial Sequence
  source: /note="Description of Artificial Sequence: Synthetic oligonucleotide"
gcuggaccugagcaggaacga

SEQ ID NO: 147 - RNA, 21 nt, Artificial Sequence
  source: /note="Description of Artificial Sequence: Synthetic oligonucleotide"
cuggaccugagcaggaacgca

SEQ ID NO: 148 - RNA, 21 nt, Artificial Sequence
  source: /note="Description of Artificial Sequence: Synthetic oligonucleotide"
ggccaucaaggcaaacguguu

SEQ ID NO: 149 - RNA, 21 nt, Artificial Sequence
  source: /note="Description of Artificial Sequence: Synthetic oligonucleotide"
gcaaccucaucgcugccguga

SEQ ID NO: 150 - RNA, 21 nt, Artificial Sequence
  source: /note="Description of Artificial Sequence: Synthetic oligonucleotide"
gcugccguggccccgggcgca

SEQ ID NO: 151 - RNA, 21 nt, Artificial Sequence
  source: /note="Description of Artificial Sequence: Synthetic oligonucleotide"
uggccccgggcgccuuccuga

SEQ ID NO: 152 - RNA, 21 nt, Artificial Sequence
  source: /note="Description of Artificial Sequence: Synthetic oligonucleotide"
gggccugaaggcgcugcgaua

SEQ ID NO: 153 - RNA, 21 nt, Artificial Sequence
  source: /note="Description of Artificial Sequence: Synthetic oligonucleotide"
gcguggcuggccuccuggaga

SEQ ID NO: 154 - RNA, 21 nt, Artificial Sequence
  source: /note="Description of Artificial Sequence: Synthetic oligonucleotide"
ggccuccuggaggacacguua

SEQ ID NO: 155 - RNA, 21 nt, Artificial Sequence
  source: /note="Description of Artificial Sequence: Synthetic oligonucleotide"
ugggccacaaccgcauccgga

SEQ ID NO: 156 - RNA, 21 nt, Artificial Sequence
  source: /note="Description of Artificial Sequence: Synthetic oligonucleotide"
ccacaaccgcauccggcagcu

SEQ ID NO: 157 - RNA, 21 nt, Artificial Sequence
  source: /note="Description of Artificial Sequence: Synthetic oligonucleotide"
agcuggcugagcgcagcuuua

SEQ ID NO: 158 - RNA, 21 nt, Artificial Sequence
  source: /note="Description of Artificial Sequence: Synthetic oligonucleotide"
cucacgcuagaccacaaccaa

SEQ ID NO: 159 - RNA, 21 nt, Artificial Sequence
  source: /note="Description of Artificial Sequence: Synthetic oligonucleotide"
ccucaccaacguggcggucau

SEQ ID NO: 160 - RNA, 21 nt, Artificial Sequence
  source: /note="Description of Artificial Sequence: Synthetic oligonucleotide"
ccucaccaacguggcggucau

SEQ ID NO: 161 - RNA, 21 nt, Artificial Sequence
  source: /note="Description of Artificial Sequence: Synthetic oligonucleotide"
caccaacguggcggucaugaa

SEQ ID NO: 162 - RNA, 21 nt, Artificial Sequence
  source: /note="Description of Artificial Sequence: Synthetic oligonucleotide"
accaacguggcggucaugaaa

SEQ ID NO: 163 - RNA, 21 nt, Artificial Sequence
  source: /note="Description of Artificial Sequence: Synthetic oligonucleotide"
ucaugaaccucucugggaacu

SEQ ID NO: 164 - RNA, 21 nt, Artificial Sequence
  source: /note="Description of Artificial Sequence: Synthetic oligonucleotide"
accucucugggaacugucuca

SEQ ID NO: 165 - RNA, 21 nt, Artificial Sequence
  source: /note="Description of Artificial Sequence: Synthetic oligonucleotide"
cucucugggaacugucuccga

SEQ ID NO: 166 - RNA, 21 nt, Artificial Sequence
  source: /note="Description of Artificial Sequence: Synthetic oligonucleotide"
gaacugucuccggaaccuuca

SEQ ID NO: 167 - RNA, 21 nt, Artificial Sequence
  source: /note="Description of Artificial Sequence: Synthetic oligonucleotide"
ggaacugucuccggaaccuua

SEQ ID NO: 168 - RNA, 21 nt, Artificial Sequence
  source: /note="Description of Artificial Sequence: Synthetic oligonucleotide"
cugucuccggaaccuuccgga

SEQ ID NO: 169 - RNA, 21 nt, Artificial Sequence
  source: /note="Description of Artificial Sequence: Synthetic oligonucleotide"
gucuccggaaccuuccggaga

SEQ ID NO: 170 - RNA, 21 nt, Artificial Sequence
  source: /note="Description of Artificial Sequence: Synthetic oligonucleotide"
cggaaccuuccggagcaggua

SEQ ID NO: 171 - RNA, 21 nt, Artificial Sequence
  source: /note="Description of Artificial Sequence: Synthetic oligonucleotide"
aaccuuccggagcagguguua

SEQ ID NO: 172 - RNA, 21 nt, Artificial Sequence
  source: /note="Description of Artificial Sequence: Synthetic oligonucleotide"
cuuccggagcagguguuccga

SEQ ID NO: 173 - RNA, 21 nt, Artificial Sequence
  source: /note="Description of Artificial Sequence: Synthetic oligonucleotide"
uuccucaaggacaacggccua

SEQ ID NO: 174 - RNA, 21 nt, Artificial Sequence
  source: /note="Description of Artificial Sequence: Synthetic oligonucleotide"
aaggacaacggccucguggga

SEQ ID NO: 175 - RNA, 21 nt, Artificial Sequence
  source: /note="Description of Artificial Sequence: Synthetic oligonucleotide"
gcugcuggagcucgaccugaa

SEQ ID NO: 176 - RNA, 21 nt, Artificial Sequence
  source: /note="Description of Artificial Sequence: Synthetic oligonucleotide"
ugaccuccaaccagcucacga

SEQ ID NO: 177 - RNA, 21 nt, Artificial Sequence
  source: /note="Description of Artificial Sequence: Synthetic oligonucleotide"
caaccagcucacgcaccugca

SEQ ID NO: 178 - RNA, 21 nt, Artificial Sequence
  source: /note="Description of Artificial Sequence: Synthetic oligonucleotide"
uggaguaccugcugcucucca

SEQ ID NO: 179 - RNA, 21 nt, Artificial Sequence
  source: /note="Description of Artificial Sequence: Synthetic oligonucleotide"
ugcagcgggccuucuggcuga

SEQ ID NO: 180 - RNA, 21 nt, Artificial Sequence
  source: /note="Description of Artificial Sequence: Synthetic oligonucleotide"
gcagcgggccuucuggcugga

SEQ ID NO: 181 - RNA, 21 nt, Artificial Sequence
  source: /note="Description of Artificial Sequence: Synthetic oligonucleotide"
uucuggcuggacgucucgcaa

SEQ ID NO: 182 - RNA, 21 nt, Artificial Sequence
  source: /note="Description of Artificial Sequence: Synthetic oligonucleotide"
ggcuggacgucucgcacaaca

SEQ ID NO: 183 - RNA, 21 nt, Artificial Sequence
  source: /note="Description of Artificial Sequence: Synthetic oligonucleotide"
ucagccucaggaacaacucaa

SEQ ID NO: 184 - RNA, 21 nt, Artificial Sequence
  source: /note="Description of Artificial Sequence: Synthetic oligonucleotide"
cagccucaggaacaacucacu

SEQ ID NO: 185 - RNA, 21 nt, Artificial Sequence
  source: /note="Description of Artificial Sequence: Synthetic oligonucleotide"
agccucaggaacaacucacua

SEQ ID NO: 186 - RNA, 21 nt, Artificial Sequence
  source: /note="Description of Artificial Sequence: Synthetic oligonucleotide"
uccaggccaucugugagggga

SEQ ID NO: 187 - RNA, 21 nt, Artificial Sequence
  source: /note="Description of Artificial Sequence: Synthetic oligonucleotide"
ggggacagguccucaguguca

SEQ ID NO: 188 - RNA, 21 nt, Artificial Sequence
  source: /note="Description of Artificial Sequence: Synthetic oligonucleotide"
ugucaucaauuaaaggcaaaa

SEQ ID NO: 189 - RNA, 21 nt, Artificial Sequence
  source: /note="Description of Artificial Sequence: Synthetic oligonucleotide"
ucaauuaaaggcaaaggcaau

SEQ ID NO: 190 - RNA, 21 nt, Artificial Sequence
  source: /note="Description of Artificial Sequence: Synthetic oligonucleotide"
aaaggcaaaggcaaucgaaua

SEQ ID NO: 191 - RNA, 21 nt, Artificial Sequence
  source: /note="Description of Artificial Sequence: Synthetic oligonucleotide"
acagaugagcucagcgucuuu

SEQ ID NO: 192 - RNA, 21 nt, Artificial Sequence
  source: /note="Description of Artificial Sequence: Synthetic oligonucleotide"
agcucagcgucuuuugcaguu

SEQ ID NO: 193 - RNA, 21 nt, Artificial Sequence
  source: /note="Description of Artificial Sequence: Synthetic oligonucleotide"
ggaccucaaccuggguuggaa

SEQ ID NO: 194 - RNA, 21 nt, Artificial Sequence
  source: /note="Description of Artificial Sequence: Synthetic oligonucleotide"
uggcaacaaacugacuuaccu

SEQ ID NO: 195 - RNA, 21 nt, Artificial Sequence
  source: /note="Description of Artificial Sequence: Synthetic oligonucleotide"
caucuccagcaucgaagaaca

SEQ ID NO: 196 - RNA, 21 nt, Artificial Sequence
  source: /note="Description of Artificial Sequence: Synthetic oligonucleotide"
cuccagcaucgaagaacagaa

SEQ ID NO: 197 - RNA, 21 nt, Artificial Sequence
  source: /note="Description of Artificial Sequence: Synthetic oligonucleotide"
cagcaucgaagaacagagccu

SEQ ID NO: 198 - RNA, 21 nt, Artificial Sequence
  source: /note="Description of Artificial Sequence: Synthetic oligonucleotide"
ucaggaauaacuccuugcaga

SEQ ID NO: 199 - RNA, 23 nt, Artificial Sequence
  source: /note="Description of Artificial Sequence: Synthetic oligonucleotide"
uuuguugccguccagccacaggg

SEQ ID NO: 200 - RNA, 23 nt, Artificial Sequence
  source: /note="Description of Artificial Sequence: Synthetic oligonucleotide"
uacgagagguuguugccguccag

SEQ ID NO: 201 - RNA, 23 nt, Artificial Sequence
  source: /note="Description of Artificial Sequence: Synthetic oligonucleotide"
uuccagccugcucagacgguugu

SEQ ID NO: 202 - RNA, 23 nt, Artificial Sequence
  source: /note="Description of Artificial Sequence: Synthetic oligonucleotide"
agccuguugcccgccagcaccag

SEQ ID NO: 203 - RNA, 23 nt, Artificial Sequence
  source: /note="Description of Artificial Sequence: Synthetic oligonucleotide"
ucguuccugcucagguccagcuc

SEQ ID NO: 204 - RNA, 23 nt, Artificial Sequence
  source: /note="Description of Artificial Sequence: Synthetic oligonucleotide"
ugcguuccugcucagguccagcu

SEQ ID NO: 205 - RNA, 23 nt, Artificial Sequence
  source: /note="Description of Artificial Sequence: Synthetic oligonucleotide"
aacacguuugccuugauggcccg

SEQ ID NO: 206 - RNA, 23 nt, Artificial Sequence
  source: /note="Description of Artificial Sequence: Synthetic oligonucleotide"
ucacggcagcgaugagguugcgg

SEQ ID NO: 207 - RNA, 23 nt, Artificial Sequence
  source: /note="Description of Artificial Sequence: Synthetic oligonucleotide"
ugcgcccggggccacggcagcga

SEQ ID NO: 208 - RNA, 23 nt, Artificial Sequence
  source: /note="Description of Artificial Sequence: Synthetic oligonucleotide"
ucaggaaggcgcccggggccacg

SEQ ID NO: 209 - RNA, 23 nt, Artificial Sequence
  source: /note="Description of Artificial Sequence: Synthetic oligonucleotide"
uaucgcagcgccuucaggcccag

SEQ ID NO: 210 - RNA, 23 nt, Artificial Sequence
  source: /note="Description of Artificial Sequence: Synthetic oligonucleotide"
ucuccaggaggccagccacgcgg

SEQ ID NO: 211 - RNA, 23 nt, Artificial Sequence
  source: /note="Description of Artificial Sequence: Synthetic oligonucleotide"
uaacguguccuccaggaggccag

SEQ ID NO: 212 - RNA, 23 nt, Artificial Sequence
  source: /note="Description of Artificial Sequence: Synthetic oligonucleotide"
uccggaugcgguuguggcccagc

SEQ ID NO: 213 - RNA, 23 nt, Artificial Sequence
  source: /note="Description of Artificial Sequence: Synthetic oligonucleotide"
agcugccggaugcgguuguggcc

SEQ ID NO: 214 - RNA, 23 nt, Artificial Sequence
  source: /note="Description of Artificial Sequence: Synthetic oligonucleotide"
uaaagcugcgcucagccagcugc

SEQ ID NO: 215 - RNA, 23 nt, Artificial Sequence
  source: /note="Description of Artificial Sequence: Synthetic oligonucleotide"
uugguuguggucuagcgugagca

SEQ ID NO: 216 - RNA, 23 nt, Artificial Sequence
  source: /note="Description of Artificial Sequence: Synthetic oligonucleotide"
augaccgccacguuggugaggcc

SEQ ID NO: 217 - RNA, 23 nt, Artificial Sequence
  source: /note="Description of Artificial Sequence: Synthetic oligonucleotide"
augaccgccacguuggugaggcc

SEQ ID NO: 218 - RNA, 23 nt, Artificial Sequence
  source: /note="Description of Artificial Sequence: Synthetic oligonucleotide"
uucaugaccgccacguuggugag

SEQ ID NO: 219 - RNA, 23 nt, Artificial Sequence
  source: /note="Description of Artificial Sequence: Synthetic oligonucleotide"
uuucaugaccgccacguugguga

SEQ ID NO: 220 - RNA, 23 nt, Artificial Sequence
  source: /note="Description of Artificial Sequence: Synthetic oligonucleotide"
aguucccagagagguucaugacc

SEQ ID NO: 221 - RNA, 23 nt, Artificial Sequence
  source: /note="Description of Artificial Sequence: Synthetic oligonucleotide"
ugagacaguucccagagagguuc

SEQ ID NO: 222 - RNA, 23 nt, Artificial Sequence
  source: /note="Description of Artificial Sequence: Synthetic oligonucleotide"
ucggagacaguucccagagaggu

SEQ ID NO: 223 - RNA, 23 nt, Artificial Sequence
  source: /note="Description of Artificial Sequence: Synthetic oligonucleotide"
ugaagguuccggagacaguuccc

SEQ ID NO: 224 - RNA, 23 nt, Artificial Sequence
  source: /note="Description of Artificial Sequence: Synthetic oligonucleotide"
uaagguuccggagacaguuccca

SEQ ID NO: 225 - RNA, 23 nt, Artificial Sequence
  source: /note="Description of Artificial Sequence: Synthetic oligonucleotide"
uccggaagguuccggagacaguu

SEQ ID NO: 226 - RNA, 23 nt, Artificial Sequence
  source: /note="Description of Artificial Sequence: Synthetic oligonucleotide"
ucuccggaagguuccggagacag

SEQ ID NO: 227 - RNA, 23 nt, Artificial Sequence
  source: /note="Description of Artificial Sequence: Synthetic oligonucleotide"
uaccugcuccggaagguuccgga

SEQ ID NO: 228 - RNA, 23 nt, Artificial Sequence
  source: /note="Description of Artificial Sequence: Synthetic oligonucleotide"
uaacaccugcuccggaagguucc

SEQ ID NO: 229 - RNA, 23 nt, Artificial Sequence
  source: /note="Description of Artificial Sequence: Synthetic oligonucleotide"
ucggaacaccugcuccggaaggu

SEQ ID NO: 230 - RNA, 23 nt, Artificial Sequence
  source: /note="Description of Artificial Sequence: Synthetic oligonucleotide"
uaggccguuguccuugaggaaga

SEQ ID NO: 231 - RNA, 23 nt, Artificial Sequence
  source: /note="Description of Artificial Sequence: Synthetic oligonucleotide"
ucccacgaggccguuguccuuga

SEQ ID NO: 232 - RNA, 23 nt, Artificial Sequence
  source: /note="Description of Artificial Sequence: Synthetic oligonucleotide"
uucaggucgagcuccagcagcuc

SEQ ID NO: 233 - RNA, 23 nt, Artificial Sequence
  source: /note="Description of Artificial Sequence: Synthetic oligonucleotide"
ucgugagcugguuggaggucagg

SEQ ID NO: 234 - RNA, 23 nt, Artificial Sequence
  source: /note="Description of Artificial Sequence: Synthetic oligonucleotide"
ugcaggugcgugagcugguugga

SEQ ID NO: 235 - RNA, 23 nt, Artificial Sequence
  source: /note="Description of Artificial Sequence: Synthetic oligonucleotide"
uggagagcagcagguacuccagc

SEQ ID NO: 236 - RNA, 23 nt, Artificial Sequence
  source: /note="Description of Artificial Sequence: Synthetic oligonucleotide"
ucagccagaaggcccgcugcagg

SEQ ID NO: 237 - RNA, 23 nt, Artificial Sequence
  source: /note="Description of Artificial Sequence: Synthetic oligonucleotide"
uccagccagaaggcccgcugcag

SEQ ID NO: 238 - RNA, 23 nt, Artificial Sequence
  source: /note="Description of Artificial Sequence: Synthetic oligonucleotide"
uugcgagacguccagccagaagg

SEQ ID NO: 239 - RNA, 23 nt, Artificial Sequence
  source: /note="Description of Artificial Sequence: Synthetic oligonucleotide"
uguugugcgagacguccagccag

SEQ ID NO: 240 - RNA, 23 nt, Artificial Sequence
  source: /note="Description of Artificial Sequence: Synthetic oligonucleotide"
uugaguuguuccugaggcugagg

SEQ ID NO: 241 - RNA, 23 nt, Artificial Sequence
  source: /note="Description of Artificial Sequence: Synthetic oligonucleotide"
agugaguuguuccugaggcugag

SEQ ID NO: 242 - RNA, 23 nt, Artificial Sequence
  source: /note="Description of Artificial Sequence: Synthetic oligonucleotide"
uagugaguuguuccugaggcuga

SEQ ID NO: 243 - RNA, 23 nt, Artificial Sequence
  source: /note="Description of Artificial Sequence: Synthetic oligonucleotide"
uccccucacagauggccuggacg

SEQ ID NO: 244 - RNA, 23 nt, Artificial Sequence
  source: /note="Description of Artificial Sequence: Synthetic oligonucleotide"
ugacacugaggaccuguccccag

SEQ ID NO: 245 - RNA, 23 nt, Artificial Sequence
  source: /note="Description of Artificial Sequence: Synthetic oligonucleotide"
uuuugccuuuaauugaugacagc

SEQ ID NO: 246 - RNA, 23 nt, Artificial Sequence
  source: /note="Description of Artificial Sequence: Synthetic oligonucleotide"
auugccuuugccuuuaauugaug

SEQ ID NO: 247 - RNA, 23 nt, Artificial Sequence
  source: /note="Description of Artificial Sequence: Synthetic oligonucleotide"
uauucgauugccuuugccuuuaa

SEQ ID NO: 248 - RNA, 23 nt, Artificial Sequence
  source: /note="Description of Artificial Sequence: Synthetic oligonucleotide"
aaagacgcugagcucaucugugu

SEQ ID NO: 249 - RNA, 23 nt, Artificial Sequence
  source: /note="Description of Artificial Sequence: Synthetic oligonucleotide"
aacugcaaaagacgcugagcuca

SEQ ID NO: 250 - RNA, 23 nt, Artificial Sequence
  source: /note="Description of Artificial Sequence: Synthetic oligonucleotide"
uuccaacccagguugagguccca

SEQ ID NO: 251 - RNA, 23 nt, Artificial Sequence
  source: /note="Description of Artificial Sequence: Synthetic oligonucleotide"
agguaagucaguuuguugccagc

SEQ ID NO: 252 - RNA, 23 nt, Artificial Sequence
  source: /note="Description of Artificial Sequence: Synthetic oligonucleotide"
uguucuucgaugcuggagaugcu

SEQ ID NO: 253 - RNA, 23 nt, Artificial Sequence
  source: /note="Description of Artificial Sequence: Synthetic oligonucleotide"
uucuguucuucgaugcuggagau

SEQ ID NO: 254 - RNA, 23 nt, Artificial Sequence
  source: /note="Description of Artificial Sequence: Synthetic oligonucleotide"
aggcucuguucuucgaugcugga

SEQ ID NO: 255 - RNA, 23 nt, Artificial Sequence
  source: /note="Description of Artificial Sequence: Synthetic oligonucleotide"
ucugcaaggaguuauuccugagg

SEQ ID NO: 256 - RNA, 19 nt, Artificial Sequence
  source: /note="Description of Artificial Sequence: Synthetic oligonucleotide"
agggcagggguggccggca

SEQ ID NO: 257 - RNA, 19 nt, Artificial Sequence
  source: /note="Description of Artificial Sequence: Synthetic oligonucleotide"
ccggcacagcagacguaca

SEQ ID NO: 258 - RNA, 19 nt, Artificial Sequence
  source: /note="Description of Artificial Sequence: Synthetic oligonucleotide"
agacguacccucccucgcu

SEQ ID NO: 259 - RNA, 19 nt, Artificial Sequence
  source: /note="Description of Artificial Sequence: Synthetic oligonucleotide"
ucccucgcugccugccuga

SEQ ID NO: 260 - RNA, 19 nt, Artificial Sequence
  source: /note="Description of Artificial Sequence: Synthetic oligonucleotide"
ugccugcagccugcccuga

SEQ ID NO: 261 - RNA, 19 nt, Artificial Sequence
  source: /note="Description of Artificial Sequence: Synthetic oligonucleotide"
ugcccugcaugcaggauga

SEQ ID NO: 262 - RNA, 19 nt, Artificial Sequence
  source: /note="Description of Artificial Sequence: Synthetic oligonucleotide"
aggauggcccugaggaaag

SEQ ID NO: 263 - RNA, 19 nt, Artificial Sequence
  source: /note="Description of Artificial Sequence: Synthetic oligonucleotide"
cugaggaaaggaggccuga

SEQ ID NO: 264 - RNA, 19 nt, Artificial Sequence
  source: /note="Description of Artificial Sequence: Synthetic oligonucleotide"
aggccuggcccuggcgcua

SEQ ID NO: 265 - RNA, 19 nt, Artificial Sequence
  source: /note="Description of Artificial Sequence: Synthetic oligonucleotide"
gcgcugcugcugcuguccu

SEQ ID NO: 266 - RNA, 19 nt, Artificial Sequence
  source: /note="Description of Artificial Sequence: Synthetic oligonucleotide"
ugcuguccuggguggcacu

SEQ ID NO: 267 - RNA, 19 nt, Artificial Sequence
  source: /note="Description of Artificial Sequence: Synthetic oligonucleotide"
uggcacugggcccccgcaa

SEQ ID NO: 268 - RNA, 19 nt, Artificial Sequence
  source: /note="Description of Artificial Sequence: Synthetic oligonucleotide"
gcccccgcagccuggagga

SEQ ID NO: 269 - RNA, 19 nt, Artificial Sequence
  source: /note="Description of Artificial Sequence: Synthetic oligonucleotide"
uggagggagcagaccccga

SEQ ID NO: 270 - RNA, 19 nt, Artificial Sequence
  source: /note="Description of Artificial Sequence: Synthetic oligonucleotide"
agaccccggaacgccggga

SEQ ID NO: 271 - RNA, 19 nt, Artificial Sequence
  source: /note="Description of Artificial Sequence: Synthetic oligonucleotide"
cgccgggggaagccgagga

SEQ ID NO: 272 - RNA, 19 nt, Artificial Sequence
  source: /note="Description of Artificial Sequence: Synthetic oligonucleotide"
cgagggcccagcgugccca

SEQ ID NO: 273 - RNA, 19 nt, Artificial Sequence
  source: /note="Description of Artificial Sequence: Synthetic oligonucleotide"
agcgugcccggccgccugu

SEQ ID NO: 274 - RNA, 19 nt, Artificial Sequence
  source: /note="Description of Artificial Sequence: Synthetic oligonucleotide"
gccugugucugcagcuaca

SEQ ID NO: 275 - RNA, 19 nt, Artificial Sequence
  source: /note="Description of Artificial Sequence: Synthetic oligonucleotide"
ugcagcuacgaugacgaca

SEQ ID NO: 276 - RNA, 19 nt, Artificial Sequence
  source: /note="Description of Artificial Sequence: Synthetic oligonucleotide"
gacgacgcggaugagcuca

SEQ ID NO: 277 - RNA, 19 nt, Artificial Sequence
  source: /note="Description of Artificial Sequence: Synthetic oligonucleotide"
augagcucagcgucuucua

SEQ ID NO: 278 - RNA, 19 nt, Artificial Sequence
  source: /note="Description of Artificial Sequence: Synthetic oligonucleotide"
ucuucugcagcuccaggaa

SEQ ID NO: 279 - RNA, 19 nt, Artificial Sequence
  source: /note="Description of Artificial Sequence: Synthetic oligonucleotide"
uccaggaaccucacgcgca

SEQ ID NO: 280 - RNA, 19 nt, Artificial Sequence
  source: /note="Description of Artificial Sequence: Synthetic oligonucleotide"
ucacgcgccugccugauga

SEQ ID NO: 281 - RNA, 19 nt, Artificial Sequence
  source: /note="Description of Artificial Sequence: Synthetic oligonucleotide"
ugauggagucccgggcgga

SEQ ID NO: 282 - RNA, 19 nt, Artificial Sequence
  source: /note="Description of Artificial Sequence: Synthetic oligonucleotide"
cgggcggcacccaagcccu

SEQ ID NO: 283 - RNA, 19 nt, Artificial Sequence
  source: /note="Description of Artificial Sequence: Synthetic oligonucleotide"
caagcccuguggcuggaca

SEQ ID NO: 284 - RNA, 19 nt, Artificial Sequence
  source: /note="Description of Artificial Sequence: Synthetic oligonucleotide"
uggcuggacggcaacaaca

SEQ ID NO: 285 - RNA, 19 nt, Artificial Sequence
  source: /note="Description of Artificial Sequence: Synthetic oligonucleotide"
aacaaccucucguccguca

SEQ ID NO: 286 - RNA, 19 nt, Artificial Sequence
  source: /note="Description of Artificial Sequence: Synthetic oligonucleotide"
uccguccccccggcagccu

SEQ ID NO: 287 - RNA, 19 nt, Artificial Sequence
  source: /note="Description of Artificial Sequence: Synthetic oligonucleotide"
cggcagccuuccagaaccu

SEQ ID NO: 288 - RNA, 19 nt, Artificial Sequence
  source: /note="Description of Artificial Sequence: Synthetic oligonucleotide"
cagaaccucuccagccuga

SEQ ID NO: 289 - RNA, 19 nt, Artificial Sequence
  source: /note="Description of Artificial Sequence: Synthetic oligonucleotide"
agccugggcuuccucaaca

SEQ ID NO: 290 - RNA, 19 nt, Artificial Sequence
  source: /note="Description of Artificial Sequence: Synthetic oligonucleotide"
uuccucaaccugcagggca

SEQ ID NO: 291 - RNA, 19 nt, Artificial Sequence
  source: /note="Description of Artificial Sequence: Synthetic oligonucleotide"
cagggcggccagcugggca

SEQ ID NO: 292 - RNA, 19 nt, Artificial Sequence
  source: /note="Description of Artificial Sequence: Synthetic oligonucleotide"
agcugggcagccuggagca

SEQ ID NO: 293 - RNA, 19 nt, Artificial Sequence
  source: /note="Description of Artificial Sequence: Synthetic oligonucleotide"
cuggagccacaggcgcuga

SEQ ID NO: 294 - RNA, 19 nt, Artificial Sequence
  source: /note="Description of Artificial Sequence: Synthetic oligonucleotide"
cgcugcugggccuagagaa

SEQ ID NO: 295 - RNA, 19 nt, Artificial Sequence
  source: /note="Description of Artificial Sequence: Synthetic oligonucleotide"
cuagagaaccugugccaca

SEQ ID NO: 296 - RNA, 19 nt, Artificial Sequence
  source: /note="Description of Artificial Sequence: Synthetic oligonucleotide"
ugugccaccugcaccugga

SEQ ID NO: 297 - RNA, 19 nt, Artificial Sequence
  source: /note="Description of Artificial Sequence: Synthetic oligonucleotide"
accuggagcggaaccagcu

SEQ ID NO: 298 - RNA, 19 nt, Artificial Sequence
  source: /note="Description of Artificial Sequence: Synthetic oligonucleotide"
aaccagcugcgcagccuga

SEQ ID NO: 299 - RNA, 19 nt, Artificial Sequence
  source: /note="Description of Artificial Sequence: Synthetic oligonucleotide"
cgcagccuggcacucggca

SEQ ID NO: 300 - RNA, 19 nt, Artificial Sequence
  source: /note="Description of Artificial Sequence: Synthetic oligonucleotide"
ucggcacguuugcacacaa

SEQ ID NO: 301 - RNA, 19 nt, Artificial Sequence
  source: /note="Description of Artificial Sequence: Synthetic oligonucleotide"
uugcacacacgcccgcgcu

SEQ ID NO: 302 - RNA, 19 nt, Artificial Sequence
  source: /note="Description of Artificial Sequence: Synthetic oligonucleotide"
cccgcgcuggccucgcuca

SEQ ID NO: 303 - RNA, 19 nt, Artificial Sequence
  source: /note="Description of Artificial Sequence: Synthetic oligonucleotide"
ucgcucggccucagcaaca

SEQ ID NO: 304 - RNA, 19 nt, Artificial Sequence
  source: /note="Description of Artificial Sequence: Synthetic oligonucleotide"
agcaacaaccgucugagca

SEQ ID NO: 305 - RNA, 19 nt, Artificial Sequence
  source: /note="Description of Artificial Sequence: Synthetic oligonucleotide"
cuggaggacgggcucuuca

SEQ ID NO: 306 - RNA, 19 nt, Artificial Sequence
  source: /note="Description of Artificial Sequence: Synthetic oligonucleotide"
cucuucgagggccucggca

SEQ ID NO: 307 - RNA, 19 nt, Artificial Sequence
  source: /note="Description of Artificial Sequence: Synthetic oligonucleotide"
ggccucggcagccucugga

SEQ ID NO: 308 - RNA, 19 nt, Artificial Sequence
  source: /note="Description of Artificial Sequence: Synthetic oligonucleotide"
ucugggaccucaaccucga

SEQ ID NO: 309 - RNA, 19 nt, Artificial Sequence
  source: /note="Description of Artificial Sequence: Synthetic oligonucleotide"
aaccucggcuggaauagca

SEQ ID NO: 310 - RNA, 19 nt, Artificial Sequence
  source: /note="Description of Artificial Sequence: Synthetic oligonucleotide"
uggaauagccuggcgguga

SEQ ID NO: 311 - RNA, 19 nt, Artificial Sequence
  source: /note="Description of Artificial Sequence: Synthetic oligonucleotide"
cggugcuccccgaugcgga

SEQ ID NO: 312 - RNA, 19 nt, Artificial Sequence
  source: /note="Description of Artificial Sequence: Synthetic oligonucleotide"
gaugcggcguuccgcggca

SEQ ID NO: 313 - RNA, 19 nt, Artificial Sequence
  source: /note="Description of Artificial Sequence: Synthetic oligonucleotide"
uuccgcggccugggcagca

SEQ ID NO: 314 - RNA, 19 nt, Artificial Sequence
  source: /note="Description of Artificial Sequence: Synthetic oligonucleotide"
gcagccugcgcgagcuggu

SEQ ID NO: 315 - RNA, 19 nt, Artificial Sequence
  source: /note="Description of Artificial Sequence: Synthetic oligonucleotide"
gagcuggugcuggcgggca

SEQ ID NO: 316 - RNA, 19 nt, Artificial Sequence
  source: /note="Description of Artificial Sequence: Synthetic oligonucleotide"
cuggcgggcaacaggcuga

SEQ ID NO: 317 - RNA, 19 nt, Artificial Sequence
  source: /note="Description of Artificial Sequence: Synthetic oligonucleotide"
aggcuggccuaccugcaga

SEQ ID NO: 318 - RNA, 19 nt, Artificial Sequence
  source: /note="Description of Artificial Sequence: Synthetic oligonucleotide"
accugcagcccgcgcucuu

SEQ ID NO: 319 - RNA, 19 nt, Artificial Sequence
  source: /note="Description of Artificial Sequence: Synthetic oligonucleotide"
cgcucuucagcggccugga

SEQ ID NO: 320 - RNA, 19 nt, Artificial Sequence
  source: /note="Description of Artificial Sequence: Synthetic oligonucleotide"
cggccuggccgagcuccga

SEQ ID NO: 321 - RNA, 19 nt, Artificial Sequence
  source: /note="Description of Artificial Sequence: Synthetic oligonucleotide"
agcuccgggagcuggaccu

SEQ ID NO: 322 - RNA, 19 nt, Artificial Sequence
  source: /note="Description of Artificial Sequence: Synthetic oligonucleotide"
cuggaccugagcaggaaca

SEQ ID NO: 323 - RNA, 19 nt, Artificial Sequence
  source: /note="Description of Artificial Sequence: Synthetic oligonucleotide"
aggaacgcgcugcgggcca

SEQ ID NO: 324 - RNA, 19 nt, Artificial Sequence
  source: /note="Description of Artificial Sequence: Synthetic oligonucleotide"
cgggccaucaaggcaaaca

SEQ ID NO: 325 - RNA, 19 nt, Artificial Sequence
  source: /note="Description of Artificial Sequence: Synthetic oligonucleotide"
aaggcaaacguguucguga

SEQ ID NO: 326 - RNA, 19 nt, Artificial Sequence
  source: /note="Description of Artificial Sequence: Synthetic oligonucleotide"
uucgugcagcugccccgga

SEQ ID NO: 327 - RNA, 19 nt, Artificial Sequence
  source: /note="Description of Artificial Sequence: Synthetic oligonucleotide"
agaaacucuaccuggacca

SEQ ID NO: 328 - RNA, 19 nt, Artificial Sequence
  source: /note="Description of Artificial Sequence: Synthetic oligonucleotide"
ccuggaccgcaaccucaua

SEQ ID NO: 329 - RNA, 19 nt, Artificial Sequence
  source: /note="Description of Artificial Sequence: Synthetic oligonucleotide"
ccucaucgcugccguggca

SEQ ID NO: 330 - RNA, 19 nt, Artificial Sequence
  source: /note="Description of Artificial Sequence: Synthetic oligonucleotide"
cguggccccgggcgccuua

SEQ ID NO: 331 - RNA, 19 nt, Artificial Sequence
  source: /note="Description of Artificial Sequence: Synthetic oligonucleotide"
ggcgccuuccugggccuga

SEQ ID NO: 332 - RNA, 19 nt, Artificial Sequence
  source: /note="Description of Artificial Sequence: Synthetic oligonucleotide"
ugggccugaaggcgcugca

SEQ ID NO: 333 - RNA, 19 nt, Artificial Sequence
  source: /note="Description of Artificial Sequence: Synthetic oligonucleotide"
cgcugcgauggcuggaccu

SEQ ID NO: 334 - RNA, 19 nt, Artificial Sequence
  source: /note="Description of Artificial Sequence: Synthetic oligonucleotide"
uggaccugucccacaacca

SEQ ID NO: 335 - RNA, 19 nt, Artificial Sequence
  source: /note="Description of Artificial Sequence: Synthetic oligonucleotide"
cacaaccgcguggcuggca

SEQ ID NO: 336 - RNA, 19 nt, Artificial Sequence
  source: /note="Description of Artificial Sequence: Synthetic oligonucleotide"
uggcuggccuccuggagga

SEQ ID NO: 337 - RNA, 19 nt, Artificial Sequence
  source: /note="Description of Artificial Sequence: Synthetic oligonucleotide"
ccuggaggacacguuccca

SEQ ID NO: 338 - RNA, 19 nt, Artificial Sequence
  source: /note="Description of Artificial Sequence: Synthetic oligonucleotide"
uuccccggucugcugggca

SEQ ID NO: 339 - RNA, 19 nt, Artificial Sequence
  source: /note="Description of Artificial Sequence: Synthetic oligonucleotide"
ugcugggccugcgugugcu

SEQ ID NO: 340 - RNA, 19 nt, Artificial Sequence
  source: /note="Description of Artificial Sequence: Synthetic oligonucleotide"
cgugugcugcggcugucca

SEQ ID NO: 341 - RNA, 19 nt, Artificial Sequence
  source: /note="Description of Artificial Sequence: Synthetic oligonucleotide"
cugucccacaacgccauca

SEQ ID NO: 342 - RNA, 19 nt, Artificial Sequence
  source: /note="Description of Artificial Sequence: Synthetic oligonucleotide"
aacgccaucgccagccuga

SEQ ID NO: 343 - RNA, 19 nt, Artificial Sequence
  source: /note="Description of Artificial Sequence: Synthetic oligonucleotide"
agccugcggccccgcaccu

SEQ ID NO: 344 - RNA, 19 nt, Artificial Sequence
  source: /note="Description of Artificial Sequence: Synthetic oligonucleotide"
cgcaccuucaaggaccuga

SEQ ID NO: 345 - RNA, 19 nt, Artificial Sequence
  source: /note="Description of Artificial Sequence: Synthetic oligonucleotide"
aaggaccugcacuuccuga

SEQ ID NO: 346 - RNA, 19 nt, Artificial Sequence
  source: /note="Description of Artificial Sequence: Synthetic oligonucleotide"
uuccuggaggagcugcaga

SEQ ID NO: 347 - RNA, 19 nt, Artificial Sequence
  source: /note="Description of Artificial Sequence: Synthetic oligonucleotide"
cugcagcugggccacaaca

SEQ ID NO: 348 - RNA, 19 nt, Artificial Sequence
  source: /note="Description of Artificial Sequence: Synthetic oligonucleotide"
ccacaaccgcauccggcaa

SEQ ID NO: 349 - RNA, 19 nt, Artificial Sequence
  source: /note="Description of Artificial Sequence: Synthetic oligonucleotide"
uccggcagcuggcugagca

SEQ ID NO: 350 - RNA, 19 nt, Artificial Sequence
  source: /note="Description of Artificial Sequence: Synthetic oligonucleotide"
uggcugagcgcagcuuuga

SEQ ID NO: 351 - RNA, 19 nt, Artificial Sequence
  source: /note="Description of Artificial Sequence: Synthetic oligonucleotide"
agcuuugagggccugggga

SEQ ID NO: 352 - RNA, 19 nt, Artificial Sequence
  source: /note="Description of Artificial Sequence: Synthetic oligonucleotide"
uggggcagcuugaggugcu

SEQ ID NO: 353 - RNA, 19 nt, Artificial Sequence
  source: /note="Description of Artificial Sequence: Synthetic oligonucleotide"
uugaggugcucacgcuaga

SEQ ID NO: 354 - RNA, 19 nt, Artificial Sequence
  source: /note="Description of Artificial Sequence: Synthetic oligonucleotide"
acgcuagaccacaaccaga

SEQ ID NO: 355 - RNA, 19 nt, Artificial Sequence
  source: /note="Description of Artificial Sequence: Synthetic oligonucleotide"
aaccagcuccaggagguca

SEQ ID NO: 356 - RNA, 19 nt, Artificial Sequence
  source: /note="Description of Artificial Sequence: Synthetic oligonucleotide"
aggaggucaaggcgggcga

SEQ ID NO: 357 - RNA, 19 nt, Artificial Sequence
  source: /note="Description of Artificial Sequence: Synthetic oligonucleotide"
cgggcgcuuuccucggccu

SEQ ID NO: 358 - RNA, 19 nt, Artificial Sequence
  source: /note="Description of Artificial Sequence: Synthetic oligonucleotide"
cucggccucaccaacguga

SEQ ID NO: 359 - RNA, 19 nt, Artificial Sequence
  source: /note="Description of Artificial Sequence: Synthetic oligonucleotide"
aacguggcggucaugaaca

SEQ ID NO: 360 - RNA, 19 nt, Artificial Sequence
  source: /note="Description of Artificial Sequence: Synthetic oligonucleotide"
ucaugaaccucucugggaa

SEQ ID NO: 361 - RNA, 19 nt, Artificial Sequence
  source: /note="Description of Artificial Sequence: Synthetic oligonucleotide"
ucugggaacugucuccgga

SEQ ID NO: 362 - RNA, 19 nt, Artificial Sequence
  source: /note="Description of Artificial Sequence: Synthetic oligonucleotide"
ucuccggaaccuuccggaa

SEQ ID NO: 363 - RNA, 19 nt, Artificial Sequence
  source: /note="Description of Artificial Sequence: Synthetic oligonucleotide"
uuccggagcagguguucca

SEQ ID NO: 364 - RNA, 19 nt, Artificial Sequence
  source: /note="Description of Artificial Sequence: Synthetic oligonucleotide"
gguguuccggggccuggga

SEQ ID NO: 365 - RNA, 19 nt, Artificial Sequence
  source: /note="Description of Artificial Sequence: Synthetic oligonucleotide"
cugggcaagcugcacagca

SEQ ID NO: 366 - RNA, 19 nt, Artificial Sequence
  source: /note="Description of Artificial Sequence: Synthetic oligonucleotide"
ugcacagccugcaccugga

SEQ ID NO: 367 - RNA, 19 nt, Artificial Sequence
  source: /note="Description of Artificial Sequence: Synthetic oligonucleotide"
cagcugccugggacgcaua

SEQ ID NO: 368 - RNA, 19 nt, Artificial Sequence
  source: /note="Description of Artificial Sequence: Synthetic oligonucleotide"
gacgcauccgcccgcacaa

SEQ ID NO: 369 - RNA, 19 nt, Artificial Sequence
  source: /note="Description of Artificial Sequence: Synthetic oligonucleotide"
cgcacaccuucaccggccu

SEQ ID NO: 370 - RNA, 19 nt, Artificial Sequence
  source: /note="Description of Artificial Sequence: Synthetic oligonucleotide"
ucaccggccucucggggcu

SEQ ID NO: 371 - RNA, 19 nt, Artificial Sequence
  source: /note="Description of Artificial Sequence: Synthetic oligonucleotide"
ucggggcuccgccgacucu

SEQ ID NO: 372 - RNA, 19 nt, Artificial Sequence
  source: /note="Description of Artificial Sequence: Synthetic oligonucleotide"
cgacucuuccucaaggaca

SEQ ID NO: 373 - RNA, 19 nt, Artificial Sequence
  source: /note="Description of Artificial Sequence: Synthetic oligonucleotide"
caaggacaacggccucgua

SEQ ID NO: 374 - RNA, 19 nt, Artificial Sequence
  source: /note="Description of Artificial Sequence: Synthetic oligonucleotide"
ggccucgugggcauugaga

SEQ ID NO: 375 - RNA, 19 nt, Artificial Sequence
  source: /note="Description of Artificial Sequence: Synthetic oligonucleotide"
uugaggagcagagccugua

SEQ ID NO: 376 - RNA, 19 nt, Artificial Sequence
  source: /note="Description of Artificial Sequence: Synthetic oligonucleotide"
agagccugugggggcugga

SEQ ID NO: 377 - RNA, 19 nt, Artificial Sequence
  source: /note="Description of Artificial Sequence: Synthetic oligonucleotide"
gggcuggcggagcugcuga

SEQ ID NO: 378 - RNA, 19 nt, Artificial Sequence
  source: /note="Description of Artificial Sequence: Synthetic oligonucleotide"
ugcuggagcucgaccugaa

SEQ ID NO: 379 - RNA, 19 nt, Artificial Sequence
  source: /note="Description of Artificial Sequence: Synthetic oligonucleotide"
gaccugaccuccaaccaga

SEQ ID NO: 380 - RNA, 19 nt, Artificial Sequence
  source: /note="Description of Artificial Sequence: Synthetic oligonucleotide"
uccaaccagcucacgcaca

SEQ ID NO: 381 - RNA, 19 nt, Artificial Sequence
  source: /note="Description of Artificial Sequence: Synthetic oligonucleotide"
acgcaccugccccaccgca

SEQ ID NO: 382 - RNA, 19 nt, Artificial Sequence
  source: /note="Description of Artificial Sequence: Synthetic oligonucleotide"
caccgccucuuccagggca

SEQ ID NO: 383 - RNA, 19 nt, Artificial Sequence
  source: /note="Description of Artificial Sequence: Synthetic oligonucleotide"
uccagggccugggcaagcu

SEQ ID NO: 384 - RNA, 19 nt, Artificial Sequence
  source: /note="Description of Artificial Sequence: Synthetic oligonucleotide"
gcaagcuggaguaccugcu

SEQ ID NO: 385 - RNA, 19 nt, Artificial Sequence
  source: /note="Description of Artificial Sequence: Synthetic oligonucleotide"
uaccugcugcucucccgca

SEQ ID NO: 386 - RNA, 19 nt, Artificial Sequence
  source: /note="Description of Artificial Sequence: Synthetic oligonucleotide"
cucucccgcaaccgccuga

SEQ ID NO: 387 - RNA, 19 nt, Artificial Sequence
  source: /note="Description of Artificial Sequence: Synthetic oligonucleotide"
ccgccuggcagagcugcca

SEQ ID NO: 388 - RNA, 19 nt, Artificial Sequence
  source: /note="Description of Artificial Sequence: Synthetic oligonucleotide"
agcugccggcggacgcccu

SEQ ID NO: 389 - RNA, 19 nt, Artificial Sequence
  source: /note="Description of Artificial Sequence: Synthetic oligonucleotide"
gacgcccugggcccccuga

SEQ ID NO: 390 - RNA, 19 nt, Artificial Sequence
  source: /note="Description of Artificial Sequence: Synthetic oligonucleotide"
ccccugcagcgggccuucu

SEQ ID NO: 391 - RNA, 19 nt, Artificial Sequence
  source: /note="Description of Artificial Sequence: Synthetic oligonucleotide"
gggccuucuggcuggacgu

SEQ ID NO: 392 - RNA, 19 nt, Artificial Sequence
  source: /note="Description of Artificial Sequence: Synthetic oligonucleotide"
uggacgucucgcacaacca

SEQ ID NO: 393 - RNA, 19 nt, Artificial Sequence
  source: /note="Description of Artificial Sequence: Synthetic oligonucleotide"
acaaccgccuggaggcauu

SEQ ID NO: 394 - RNA, 19 nt, Artificial Sequence
  source: /note="Description of Artificial Sequence: Synthetic oligonucleotide"
gaggcauugcccaacagca

SEQ ID NO: 395 - RNA, 19 nt, Artificial Sequence
  source: /note="Description of Artificial Sequence: Synthetic oligonucleotide"
caacagccucuuggcacca

SEQ ID NO: 396 - RNA, 19 nt, Artificial Sequence
  source: /note="Description of Artificial Sequence: Synthetic oligonucleotide"
uuggcaccacuggggcgga

SEQ ID NO: 397 - RNA, 19 nt, Artificial Sequence
  source: /note="Description of Artificial Sequence: Synthetic oligonucleotide"
uggggcggcugcgcuaccu

SEQ ID NO: 398 - RNA, 19 nt, Artificial Sequence
  source: /note="Description of Artificial Sequence: Synthetic oligonucleotide"
cgcuaccucagccucagga

SEQ ID NO: 399 - RNA, 19 nt, Artificial Sequence
  source: /note="Description of Artificial Sequence: Synthetic oligonucleotide"
ucaggaacaacucacugca

SEQ ID NO: 400 - RNA, 19 nt, Artificial Sequence
  source: /note="Description of Artificial Sequence: Synthetic oligonucleotide"
cucacugcggaccuucaca

SEQ ID NO: 401 - RNA, 19 nt, Artificial Sequence
  source: /note="Description of Artificial Sequence: Synthetic oligonucleotide"
accuucacgccgcagccca

SEQ ID NO: 402 - RNA, 19 nt, Artificial Sequence
  source: /note="Description of Artificial Sequence: Synthetic oligonucleotide"
cagcccccgggccuggaga

SEQ ID NO: 403 - RNA, 19 nt, Artificial Sequence
  source: /note="Description of Artificial Sequence: Synthetic oligonucleotide"
gccuggagcgccuguggcu

SEQ ID NO: 404 - RNA, 19 nt, Artificial Sequence
  source: /note="Description of Artificial Sequence: Synthetic oligonucleotide"
cuguggcuggaggguaaca

SEQ ID NO: 405 - RNA, 19 nt, Artificial Sequence
  source: /note="Description of Artificial Sequence: Synthetic oligonucleotide"
gguaaccccugggacugua

SEQ ID NO: 406 - RNA, 19 nt, Artificial Sequence
  source: /note="Description of Artificial Sequence: Synthetic oligonucleotide"
gggacuguggcugcccucu

SEQ ID NO: 407 - RNA, 19 nt, Artificial Sequence
  source: /note="Description of Artificial Sequence: Synthetic oligonucleotide"
ugcccucucaaggcgcuga

SEQ ID NO: 408 - RNA, 19 nt, Artificial Sequence
  source: /note="Description of Artificial Sequence: Synthetic oligonucleotide"
cgcugcgggacuucgcccu

SEQ ID NO: 409 - RNA, 19 nt, Artificial Sequence
  source: /note="Description of Artificial Sequence: Synthetic oligonucleotide"
uucgcccugcagaacccca

SEQ ID NO: 410 - RNA, 19 nt, Artificial Sequence
  source: /note="Description of Artificial Sequence: Synthetic oligonucleotide"
cagaaccccagugcuguga

SEQ ID NO: 411 - RNA, 19 nt, Artificial Sequence
  source: /note="Description of Artificial Sequence: Synthetic oligonucleotide"
ugcugugccccgcuucgua

SEQ ID NO: 412 - RNA, 19 nt, Artificial Sequence
  source: /note="Description of Artificial Sequence: Synthetic oligonucleotide"
cuucguccaggccaucugu

SEQ ID NO: 413 - RNA, 19 nt, Artificial Sequence
  source: /note="Description of Artificial Sequence: Synthetic oligonucleotide"
caucugugagggggacgau

SEQ ID NO: 414 - RNA, 19 nt, Artificial Sequence
  source: /note="Description of Artificial Sequence: Synthetic oligonucleotide"
ggggacgauugccagccga

SEQ ID NO: 415 - RNA, 19 nt, Artificial Sequence
  source: /note="Description of Artificial Sequence: Synthetic oligonucleotide"
cagccgcccgcguacaccu

SEQ ID NO: 416 - RNA, 19 nt, Artificial Sequence
  source: /note="Description of Artificial Sequence: Synthetic oligonucleotide"
cguacaccuacaacaacau

SEQ ID NO: 417 - RNA, 19 nt, Artificial Sequence
  source: /note="Description of Artificial Sequence: Synthetic oligonucleotide"
aacaacaucaccugugcca

SEQ ID NO: 418 - RNA, 19 nt, Artificial Sequence
  source: /note="Description of Artificial Sequence: Synthetic oligonucleotide"
ugugccagcccgcccgaga

SEQ ID NO: 419 - RNA, 19 nt, Artificial Sequence
  source: /note="Description of Artificial Sequence: Synthetic oligonucleotide"
cgcccgaggucguggggcu

SEQ ID NO: 420 - RNA, 19 nt, Artificial Sequence
  source: /note="Description of Artificial Sequence: Synthetic oligonucleotide"
cguggggcucgaccugcga

SEQ ID NO: 421 - RNA, 19 nt, Artificial Sequence
  source: /note="Description of Artificial Sequence: Synthetic oligonucleotide"
accugcgggaccucagcga

SEQ ID NO: 422 - RNA, 19 nt, Artificial Sequence
  source: /note="Description of Artificial Sequence: Synthetic oligonucleotide"
ucagcgaggcccacuuuga

SEQ ID NO: 423 - RNA, 19 nt, Artificial Sequence
  source: /note="Description of Artificial Sequence: Synthetic oligonucleotide"
acuuugcucccugcugaca

SEQ ID NO: 424 - RNA, 19 nt, Artificial Sequence
  source: /note="Description of Artificial Sequence: Synthetic oligonucleotide"
ccugcugaccaggucccca

SEQ ID NO: 425 - RNA, 19 nt, Artificial Sequence
  source: /note="Description of Artificial Sequence: Synthetic oligonucleotide"
uccccggacucaagcccca

SEQ ID NO: 426 - RNA, 19 nt, Artificial Sequence
  source: /note="Description of Artificial Sequence: Synthetic oligonucleotide"
caagccccggacucaggca

SEQ ID NO: 427 - RNA, 19 nt, Artificial Sequence
  source: /note="Description of Artificial Sequence: Synthetic oligonucleotide"
ucaggcccccaccuggcua

SEQ ID NO: 428 - RNA, 19 nt, Artificial Sequence
  source: /note="Description of Artificial Sequence: Synthetic oligonucleotide"
accuggcucaccuugugcu

SEQ ID NO: 429 - RNA, 19 nt, Artificial Sequence
  source: /note="Description of Artificial Sequence: Synthetic oligonucleotide"
uugugcuggggacagguca

SEQ ID NO: 430 - RNA, 19 nt, Artificial Sequence
  source: /note="Description of Artificial Sequence: Synthetic oligonucleotide"
gacagguccucaguguccu

SEQ ID NO: 431 - RNA, 19 nt, Artificial Sequence
  source: /note="Description of Artificial Sequence: Synthetic oligonucleotide"
caguguccucaggggccua

SEQ ID NO: 432 - RNA, 19 nt, Artificial Sequence
  source: /note="Description of Artificial Sequence: Synthetic oligonucleotide"
gggccugcccagugcacuu

SEQ ID NO: 433 - RNA, 19 nt, Artificial Sequence
  source: /note="Description of Artificial Sequence: Synthetic oligonucleotide"
ugcacuugcuggaagacga

SEQ ID NO: 434 - RNA, 19 nt, Artificial Sequence
  source: /note="Description of Artificial Sequence: Synthetic oligonucleotide"
uggaagacgcaagggccua

SEQ ID NO: 435 - RNA, 19 nt, Artificial Sequence
  source: /note="Description of Artificial Sequence: Synthetic oligonucleotide"
agggccugaugggguggaa

SEQ ID NO: 436 - RNA, 19 nt, Artificial Sequence
  source: /note="Description of Artificial Sequence: Synthetic oligonucleotide"
ggguggaaggcauggcgga

SEQ ID NO: 437 - RNA, 19 nt, Artificial Sequence
  source: /note="Description of Artificial Sequence: Synthetic oligonucleotide"
uggcggcccccccagcugu

SEQ ID NO: 438 - RNA, 19 nt, Artificial Sequence
  source: /note="Description of Artificial Sequence: Synthetic oligonucleotide"
cagcugucaucaauuaaag

SEQ ID NO: 439 - RNA, 19 nt, Artificial Sequence
  source: /note="Description of Artificial Sequence: Synthetic oligonucleotide"
aauuaaaggcaaaggcaau

SEQ ID NO: 440 - RNA, 19 nt, Artificial Sequence
  source: /note="Description of Artificial Sequence: Synthetic oligonucleotide"
aaggcaaucgaaucuaaaa

SEQ ID NO: 441 - RNA, 19 nt, Artificial Sequence
  source: /note="Description of Artificial Sequence: Synthetic oligonucleotide"
ugccggccaccccugcccu

SEQ ID NO: 442 - RNA, 19 nt, Artificial Sequence
  source: /note="Description of Artificial Sequence: Synthetic oligonucleotide"
uguacgucugcugugccgg

SEQ ID NO: 443 - RNA, 19 nt, Artificial Sequence
  source: /note="Description of Artificial Sequence: Synthetic oligonucleotide"
agcgagggaggguacgucu

SEQ ID NO: 444 - RNA, 19 nt, Artificial Sequence
  source: /note="Description of Artificial Sequence: Synthetic oligonucleotide"
ucaggcaggcagcgaggga

SEQ ID NO: 445 - RNA, 19 nt, Artificial Sequence
  source: /note="Description of Artificial Sequence: Synthetic oligonucleotide"
ucagggcaggcugcaggca

SEQ ID NO: 446 - RNA, 19 nt, Artificial Sequence
  source: /note="Description of Artificial Sequence: Synthetic oligonucleotide"
ucauccugcaugcagggca

SEQ ID NO: 447 - RNA, 19 nt, Artificial Sequence
  source: /note="Description of Artificial Sequence: Synthetic oligonucleotide"
cuuuccucagggccauccu

SEQ ID NO: 448 - RNA, 19 nt, Artificial Sequence
  source: /note="Description of Artificial Sequence: Synthetic oligonucleotide"
ucaggccuccuuuccucag

SEQ ID NO: 449 - RNA, 19 nt, Artificial Sequence
  source: /note="Description of Artificial Sequence: Synthetic oligonucleotide"
uagcgccagggccaggccu

SEQ ID NO: 450 - RNA, 19 nt, Artificial Sequence
  source: /note="Description of Artificial Sequence: Synthetic oligonucleotide"
aggacagcagcagcagcgc

SEQ ID NO: 451 - RNA, 19 nt, Artificial Sequence
  source: /note="Description of Artificial Sequence: Synthetic oligonucleotide"
agugccacccaggacagca

SEQ ID NO: 452 - RNA, 19 nt, Artificial Sequence
  source: /note="Description of Artificial Sequence: Synthetic oligonucleotide"
uugcgggggcccagugcca

SEQ ID NO: 453 - RNA, 19 nt, Artificial Sequence
  source: /note="Description of Artificial Sequence: Synthetic oligonucleotide"
uccuccaggcugcgggggc

SEQ ID NO: 454 - RNA, 19 nt, Artificial Sequence
  source: /note="Description of Artificial Sequence: Synthetic oligonucleotide"
ucggggucugcucccucca

SEQ ID NO: 455 - RNA, 19 nt, Artificial Sequence
  source: /note="Description of Artificial Sequence: Synthetic oligonucleotide"
ucccggcguuccggggucu

SEQ ID NO: 456 - RNA, 19 nt, Artificial Sequence
  source: /note="Description of Artificial Sequence: Synthetic oligonucleotide"
uccucggcuucccccggcg

SEQ ID NO: 457 - RNA, 19 nt, Artificial Sequence
  source: /note="Description of Artificial Sequence: Synthetic oligonucleotide"
ugggcacgcugggcccucg

SEQ ID NO: 458 - RNA, 19 nt, Artificial Sequence
  source: /note="Description of Artificial Sequence: Synthetic oligonucleotide"
acaggcggccgggcacgcu

SEQ ID NO: 459 - RNA, 19 nt, Artificial Sequence
  source: /note="Description of Artificial Sequence: Synthetic oligonucleotide"
uguagcugcagacacaggc

SEQ ID NO: 460 - RNA, 19 nt, Artificial Sequence
  source: /note="Description of Artificial Sequence: Synthetic oligonucleotide"
ugucgucaucguagcugca

SEQ ID NO: 461 - RNA, 19 nt, Artificial Sequence
  source: /note="Description of Artificial Sequence: Synthetic oligonucleotide"
ugagcucauccgcgucguc

SEQ ID NO: 462 - RNA, 19 nt, Artificial Sequence
  source: /note="Description of Artificial Sequence: Synthetic oligonucleotide"
uagaagacgcugagcucau

SEQ ID NO: 463 - RNA, 19 nt, Artificial Sequence
  source: /note="Description of Artificial Sequence: Synthetic oligonucleotide"
uuccuggagcugcagaaga

SEQ ID NO: 464 - RNA, 19 nt, Artificial Sequence
  source: /note="Description of Artificial Sequence: Synthetic oligonucleotide"
ugcgcgugagguuccugga

SEQ ID NO: 465 - RNA, 19 nt, Artificial Sequence
  source: /note="Description of Artificial Sequence: Synthetic oligonucleotide"
ucaucaggcaggcgcguga

SEQ ID NO: 466 - RNA, 19 nt, Artificial Sequence
  source: /note="Description of Artificial Sequence: Synthetic oligonucleotide"
uccgcccgggacuccauca

SEQ ID NO: 467 - RNA, 19 nt, Artificial Sequence
  source: /note="Description of Artificial Sequence: Synthetic oligonucleotide"
agggcuugggugccgcccg

SEQ ID NO: 468 - RNA, 19 nt, Artificial Sequence
  source: /note="Description of Artificial Sequence: Synthetic oligonucleotide"
uguccagccacagggcuug

SEQ ID NO: 469 - RNA, 19 nt, Artificial Sequence
  source: /note="Description of Artificial Sequence: Synthetic oligonucleotide"
uguuguugccguccagcca

SEQ ID NO: 470 - RNA, 19 nt, Artificial Sequence
  source: /note="Description of Artificial Sequence: Synthetic oligonucleotide"
ugacggacgagagguuguu

SEQ ID NO: 471 - RNA, 19 nt, Artificial Sequence
  source: /note="Description of Artificial Sequence: Synthetic oligonucleotide"
aggcugccggggggacgga

SEQ ID NO: 472 - RNA, 19 nt, Artificial Sequence
  source: /note="Description of Artificial Sequence: Synthetic oligonucleotide"
agguucuggaaggcugccg

SEQ ID NO: 473 - RNA, 19 nt, Artificial Sequence
  source: /note="Description of Artificial Sequence: Synthetic oligonucleotide"
ucaggcuggagagguucug

SEQ ID NO: 474 - RNA, 19 nt, Artificial Sequence
  source: /note="Description of Artificial Sequence: Synthetic oligonucleotide"
uguugaggaagcccaggcu

SEQ ID NO: 475 - RNA, 19 nt, Artificial Sequence
  source: /note="Description of Artificial Sequence: Synthetic oligonucleotide"
ugcccugcagguugaggaa

SEQ ID NO: 476 - RNA, 19 nt, Artificial Sequence
  source: /note="Description of Artificial Sequence: Synthetic oligonucleotide"
ugcccagcuggccgcccug

SEQ ID NO: 477 - RNA, 19 nt, Artificial Sequence
  source: /note="Description of Artificial Sequence: Synthetic oligonucleotide"
ugcuccaggcugcccagcu

SEQ ID NO: 478 - RNA, 19 nt, Artificial Sequence
  source: /note="Description of Artificial Sequence: Synthetic oligonucleotide"
ucagcgccuguggcuccag

SEQ ID NO: 479 - RNA, 19 nt, Artificial Sequence
  source: /note="Description of Artificial Sequence: Synthetic oligonucleotide"
uucucuaggcccagcagcg

SEQ ID NO: 480 - RNA, 19 nt, Artificial Sequence
  source: /note="Description of Artificial Sequence: Synthetic oligonucleotide"
uguggcacagguucucuag

SEQ ID NO: 481 - RNA, 19 nt, Artificial Sequence
  source: /note="Description of Artificial Sequence: Synthetic oligonucleotide"
uccaggugcagguggcaca

SEQ ID NO: 482 - RNA, 19 nt, Artificial Sequence
  source: /note="Description of Artificial Sequence: Synthetic oligonucleotide"
agcugguuccgcuccaggu

SEQ ID NO: 483 - RNA, 19 nt, Artificial Sequence
  source: /note="Description of Artificial Sequence: Synthetic oligonucleotide"
ucaggcugcgcagcugguu

SEQ ID NO: 484 - RNA, 19 nt, Artificial Sequence
  source: /note="Description of Artificial Sequence: Synthetic oligonucleotide"
ugccgagugccaggcugcg

SEQ ID NO: 485 - RNA, 19 nt, Artificial Sequence
  source: /note="Description of Artificial Sequence: Synthetic oligonucleotide"
uugugugcaaacgugccga

SEQ ID NO: 486 - RNA, 19 nt, Artificial Sequence
  source: /note="Description of Artificial Sequence: Synthetic oligonucleotide"
agcgcgggcgugugugcaa

SEQ ID NO: 487 - RNA, 19 nt, Artificial Sequence
  source: /note="Description of Artificial Sequence: Synthetic oligonucleotide"
ugagcgaggccagcgcggg

SEQ ID NO: 488 - RNA, 19 nt, Artificial Sequence
  source: /note="Description of Artificial Sequence: Synthetic oligonucleotide"
uguugcugaggccgagcga

SEQ ID NO: 489 - RNA, 19 nt, Artificial Sequence
  source: /note="Description of Artificial Sequence: Synthetic oligonucleotide"
ugcucagacgguuguugcu

SEQ ID NO: 490 - RNA, 19 nt, Artificial Sequence
  source: /note="Description of Artificial Sequence: Synthetic oligonucleotide"
ugaagagcccguccuccag

SEQ ID NO: 491 - RNA, 19 nt, Artificial Sequence
  source: /note="Description of Artificial Sequence: Synthetic oligonucleotide"
ugccgaggcccucgaagag

SEQ ID NO: 492 - RNA, 19 nt, Artificial Sequence
  source: /note="Description of Artificial Sequence: Synthetic oligonucleotide"
uccagaggcugccgaggcc

SEQ ID NO: 493 - RNA, 19 nt, Artificial Sequence
  source: /note="Description of Artificial Sequence: Synthetic oligonucleotide"
ucgagguugaggucccaga

SEQ ID NO: 494 - RNA, 19 nt, Artificial Sequence
  source: /note="Description of Artificial Sequence: Synthetic oligonucleotide"
ugcuauuccagccgagguu

SEQ ID NO: 495 - RNA, 19 nt, Artificial Sequence
  source: /note="Description of Artificial Sequence: Synthetic oligonucleotide"
ucaccgccaggcuauucca

SEQ ID NO: 496 - RNA, 19 nt, Artificial Sequence
  source: /note="Description of Artificial Sequence: Synthetic oligonucleotide"
uccgcaucggggagcaccg

SEQ ID NO: 497 - RNA, 19 nt, Artificial Sequence
  source: /note="Description of Artificial Sequence: Synthetic oligonucleotide"
ugccgcggaacgccgcauc

SEQ ID NO: 498 - RNA, 19 nt, Artificial Sequence
  source: /note="Description of Artificial Sequence: Synthetic oligonucleotide"
ugcugcccaggccgcggaa

SEQ ID NO: 499 - RNA, 19 nt, Artificial Sequence
  source: /note="Description of Artificial Sequence: Synthetic oligonucleotide"
accagcucgcgcaggcugc

SEQ ID NO: 500 - RNA, 19 nt, Artificial Sequence
  source: /note="Description of Artificial Sequence: Synthetic oligonucleotide"
ugcccgccagcaccagcuc

SEQ ID NO: 501 - RNA, 19 nt, Artificial Sequence
  source: /note="Description of Artificial Sequence: Synthetic oligonucleotide"
ucagccuguugcccgccag

SEQ ID NO: 502 - RNA, 19 nt, Artificial Sequence
  source: /note="Description of Artificial Sequence: Synthetic oligonucleotide"
ucugcagguaggccagccu

SEQ ID NO: 503 - RNA, 19 nt, Artificial Sequence
  source: /note="Description of Artificial Sequence: Synthetic oligonucleotide"
aagagcgcgggcugcaggu

SEQ ID NO: 504 - RNA, 19 nt, Artificial Sequence
  source: /note="Description of Artificial Sequence: Synthetic oligonucleotide"
uccaggccgcugaagagcg

SEQ ID NO: 505 - RNA, 19 nt, Artificial Sequence
  source: /note="Description of Artificial Sequence: Synthetic oligonucleotide"
ucggagcucggccaggccg

SEQ ID NO: 506 - RNA, 19 nt, Artificial Sequence
  source: /note="Description of Artificial Sequence: Synthetic oligonucleotide"
agguccagcucccggagcu

SEQ ID NO: 507 - RNA, 19 nt, Artificial Sequence
  source: /note="Description of Artificial Sequence: Synthetic oligonucleotide"
uguuccugcucagguccag

SEQ ID NO: 508 - RNA, 19 nt, Artificial Sequence
  source: /note="Description of Artificial Sequence: Synthetic oligonucleotide"
uggcccgcagcgcguuccu

SEQ ID NO: 509 - RNA, 19 nt, Artificial Sequence
  source: /note="Description of Artificial Sequence: Synthetic oligonucleotide"
uguuugccuugauggcccg

SEQ ID NO: 510 - RNA, 19 nt, Artificial Sequence
  source: /note="Description of Artificial Sequence: Synthetic oligonucleotide"
ucacgaacacguuugccuu

SEQ ID NO: 511 - RNA, 19 nt, Artificial Sequence
  source: /note="Description of Artificial Sequence: Synthetic oligonucleotide"
uccggggcagcugcacgaa

SEQ ID NO: 512 - RNA, 19 nt, Artificial Sequence
  source: /note="Description of Artificial Sequence: Synthetic oligonucleotide"
ugguccagguagaguuucu

SEQ ID NO: 513 - RNA, 19 nt, Artificial Sequence
  source: /note="Description of Artificial Sequence: Synthetic oligonucleotide"
uaugagguugcgguccagg

SEQ ID NO: 514 - RNA, 19 nt, Artificial Sequence
  source: /note="Description of Artificial Sequence: Synthetic oligonucleotide"
ugccacggcagcgaugagg

SEQ ID NO: 515 - RNA, 19 nt, Artificial Sequence
  source: /note="Description of Artificial Sequence: Synthetic oligonucleotide"
uaaggcgcccggggccacg

SEQ ID NO: 516 - RNA, 19 nt, Artificial Sequence
  source: /note="Description of Artificial Sequence: Synthetic oligonucleotide"
ucaggcccaggaaggcgcc

SEQ ID NO: 517 - RNA, 19 nt, Artificial Sequence
  source: /note="Description of Artificial Sequence: Synthetic oligonucleotide"
ugcagcgccuucaggccca

SEQ ID NO: 518 - RNA, 19 nt, Artificial Sequence
  source: /note="Description of Artificial Sequence: Synthetic oligonucleotide"
agguccagccaucgcagcg

SEQ ID NO: 519 - RNA, 19 nt, Artificial Sequence
  source: /note="Description of Artificial Sequence: Synthetic oligonucleotide"
ugguugugggacaggucca

SEQ ID NO: 520 - RNA, 19 nt, Artificial Sequence
  source: /note="Description of Artificial Sequence: Synthetic oligonucleotide"
ugccagccacgcgguugug

SEQ ID NO: 521 - RNA, 19 nt, Artificial Sequence
  source: /note="Description of Artificial Sequence: Synthetic oligonucleotide"
uccuccaggaggccagcca

SEQ ID NO: 522 - RNA, 19 nt, Artificial Sequence
  source: /note="Description of Artificial Sequence: Synthetic oligonucleotide"
ugggaacguguccuccagg

SEQ ID NO: 523 - RNA, 19 nt, Artificial Sequence
  source: /note="Description of Artificial Sequence: Synthetic oligonucleotide"
ugcccagcagaccggggaa

SEQ ID NO: 524 - RNA, 19 nt, Artificial Sequence
  source: /note="Description of Artificial Sequence: Synthetic oligonucleotide"
agcacacgcaggcccagca

SEQ ID NO: 525 - RNA, 19 nt, Artificial Sequence
  source: /note="Description of Artificial Sequence: Synthetic oligonucleotide"
uggacagccgcagcacacg

SEQ ID NO: 526 - RNA, 19 nt, Artificial Sequence
  source: /note="Description of Artificial Sequence: Synthetic oligonucleotide"
ugauggcguugugggacag

SEQ ID NO: 527 - RNA, 19 nt, Artificial Sequence
  source: /note="Description of Artificial Sequence: Synthetic oligonucleotide"
ucaggcuggcgauggcguu

SEQ ID NO: 528 - RNA, 19 nt, Artificial Sequence
  source: /note="Description of Artificial Sequence: Synthetic oligonucleotide"
aggugcggggccgcaggcu

SEQ ID NO: 529 - RNA, 19 nt, Artificial Sequence
  source: /note="Description of Artificial Sequence: Synthetic oligonucleotide"
ucagguccuugaaggugcg

SEQ ID NO: 530 - RNA, 19 nt, Artificial Sequence
  source: /note="Description of Artificial Sequence: Synthetic oligonucleotide"
ucaggaagugcagguccuu

SEQ ID NO: 531 - RNA, 19 nt, Artificial Sequence
  source: /note="Description of Artificial Sequence: Synthetic oligonucleotide"
ucugcagcuccuccaggaa

SEQ ID NO: 532 - RNA, 19 nt, Artificial Sequence
  source: /note="Description of Artificial Sequence: Synthetic oligonucleotide"
uguuguggcccagcugcag

SEQ ID NO: 533 - RNA, 19 nt, Artificial Sequence
  source: /note="Description of Artificial Sequence: Synthetic oligonucleotide"
uugccggaugcgguugugg

SEQ ID NO: 534 - RNA, 19 nt, Artificial Sequence
  source: /note="Description of Artificial Sequence: Synthetic oligonucleotide"
ugcucagccagcugccgga

SEQ ID NO: 535 - RNA, 19 nt, Artificial Sequence
  source: /note="Description of Artificial Sequence: Synthetic oligonucleotide"
ucaaagcugcgcucagcca

SEQ ID NO: 536 - RNA, 19 nt, Artificial Sequence
  source: /note="Description of Artificial Sequence: Synthetic oligonucleotide"
uccccaggcccucaaagcu

SEQ ID NO: 537 - RNA, 19 nt, Artificial Sequence
  source: /note="Description of Artificial Sequence: Synthetic oligonucleotide"
agcaccucaagcugcccca

SEQ ID NO: 538 - RNA, 19 nt, Artificial Sequence
  source: /note="Description of Artificial Sequence: Synthetic oligonucleotide"
ucuagcgugagcaccucaa

SEQ ID NO: 539 - RNA, 19 nt, Artificial Sequence
  source: /note="Description of Artificial Sequence: Synthetic oligonucleotide"
ucugguuguggucuagcgu

SEQ ID NO: 540 - RNA, 19 nt, Artificial Sequence
  source: /note="Description of Artificial Sequence: Synthetic oligonucleotide"
ugaccuccuggagcugguu

SEQ ID NO: 541 - RNA, 19 nt, Artificial Sequence
  source: /note="Description of Artificial Sequence: Synthetic oligonucleotide"
ucgcccgccuugaccuccu

SEQ ID NO: 542 - RNA, 19 nt, Artificial Sequence
  source: /note="Description of Artificial Sequence: Synthetic oligonucleotide"
aggccgaggaaagcgcccg

SEQ ID NO: 543 - RNA, 19 nt, Artificial Sequence
  source: /note="Description of Artificial Sequence: Synthetic oligonucleotide"
ucacguuggugaggccgag

SEQ ID NO: 544 - RNA, 19 nt, Artificial Sequence
  source: /note="Description of Artificial Sequence: Synthetic oligonucleotide"
uguucaugaccgccacguu

SEQ ID NO: 545 - RNA, 19 nt, Artificial Sequence
  source: /note="Description of Artificial Sequence: Synthetic oligonucleotide"
uucccagagagguucauga

SEQ ID NO: 546 - RNA, 19 nt, Artificial Sequence
  source: /note="Description of Artificial Sequence: Synthetic oligonucleotide"
uccggagacaguucccaga

SEQ ID NO: 547 - RNA, 19 nt, Artificial Sequence
  source: /note="Description of Artificial Sequence: Synthetic oligonucleotide"
uuccggaagguuccggaga

SEQ ID NO: 548 - RNA, 19 nt, Artificial Sequence
  source: /note="Description of Artificial Sequence: Synthetic oligonucleotide"
uggaacaccugcuccggaa

SEQ ID NO: 549 - RNA, 19 nt, Artificial Sequence
  source: /note="Description of Artificial Sequence: Synthetic oligonucleotide"
ucccaggccccggaacacc

SEQ ID NO: 550 - RNA, 19 nt, Artificial Sequence
  source: /note="Description of Artificial Sequence: Synthetic oligonucleotide"
ugcugugcagcuugcccag

SEQ ID NO: 551 - RNA, 19 nt, Artificial Sequence
  source: /note="Description of Artificial Sequence: Synthetic oligonucleotide"
uccaggugcaggcugugca

SEQ ID NO: 552 - RNA, 19 nt, Artificial Sequence
  source: /note="Description of Artificial Sequence: Synthetic oligonucleotide"
uaugcgucccaggcagcug

SEQ ID NO: 553 - RNA, 19 nt, Artificial Sequence
  source: /note="Description of Artificial Sequence: Synthetic oligonucleotide"
uugugcgggcggaugcguc

SEQ ID NO: 554 - RNA, 19 nt, Artificial Sequence
  source: /note="Description of Artificial Sequence: Synthetic oligonucleotide"
aggccggugaaggugugcg

SEQ ID NO: 555 - RNA, 19 nt, Artificial Sequence
  source: /note="Description of Artificial Sequence: Synthetic oligonucleotide"
agccccgagaggccgguga

SEQ ID NO: 556 - RNA, 19 nt, Artificial Sequence
  source: /note="Description of Artificial Sequence: Synthetic oligonucleotide"
agagucggcggagccccga

SEQ ID NO: 557 - RNA, 19 nt, Artificial Sequence
  source: /note="Description of Artificial Sequence: Synthetic oligonucleotide"
uguccuugaggaagagucg

SEQ ID NO: 558 - RNA, 19 nt, Artificial Sequence
  source: /note="Description of Artificial Sequence: Synthetic oligonucleotide"
uacgaggccguuguccuug

SEQ ID NO: 559 - RNA, 19 nt, Artificial Sequence
  source: /note="Description of Artificial Sequence: Synthetic oligonucleotide"
ucucaaugcccacgaggcc

SEQ ID NO: 560 - RNA, 19 nt, Artificial Sequence
  source: /note="Description of Artificial Sequence: Synthetic oligonucleotide"
uacaggcucugcuccucaa

SEQ ID NO: 561 - RNA, 19 nt, Artificial Sequence
  source: /note="Description of Artificial Sequence: Synthetic oligonucleotide"
uccagcccccacaggcucu

SEQ ID NO: 562 - RNA, 19 nt, Artificial Sequence
  source: /note="Description of Artificial Sequence: Synthetic oligonucleotide"
ucagcagcuccgccagccc

SEQ ID NO: 563 - RNA, 19 nt, Artificial Sequence
  source: /note="Description of Artificial Sequence: Synthetic oligonucleotide"
uucaggucgagcuccagca

SEQ ID NO: 564 - RNA, 19 nt, Artificial Sequence
  source: /note="Description of Artificial Sequence: Synthetic oligonucleotide"
ucugguuggaggucagguc

SEQ ID NO: 565 - RNA, 19 nt, Artificial Sequence
  source: /note="Description of Artificial Sequence: Synthetic oligonucleotide"
ugugcgugagcugguugga

SEQ ID NO: 566 - RNA, 19 nt, Artificial Sequence
  source: /note="Description of Artificial Sequence: Synthetic oligonucleotide"
ugcgguggggcaggugcgu

SEQ ID NO: 567 - RNA, 19 nt, Artificial Sequence
  source: /note="Description of Artificial Sequence: Synthetic oligonucleotide"
ugcccuggaagaggcggug

SEQ ID NO: 568 - RNA, 19 nt, Artificial Sequence
  source: /note="Description of Artificial Sequence: Synthetic oligonucleotide"
agcuugcccaggcccugga

SEQ ID NO: 569 - RNA, 19 nt, Artificial Sequence
  source: /note="Description of Artificial Sequence: Synthetic oligonucleotide"
agcagguacuccagcuugc

SEQ ID NO: 570 - RNA, 19 nt, Artificial Sequence
  source: /note="Description of Artificial Sequence: Synthetic oligonucleotide"
ugcgggagagcagcaggua

SEQ ID NO: 571 - RNA, 19 nt, Artificial Sequence
  source: /note="Description of Artificial Sequence: Synthetic oligonucleotide"
ucaggcgguugcgggagag

SEQ ID NO: 572 - RNA, 19 nt, Artificial Sequence
  source: /note="Description of Artificial Sequence: Synthetic oligonucleotide"
uggcagcucugccaggcgg

SEQ ID NO: 573 - RNA, 19 nt, Artificial Sequence
  source: /note="Description of Artificial Sequence: Synthetic oligonucleotide"
agggcguccgccggcagcu

SEQ ID NO: 574 - RNA, 19 nt, Artificial Sequence
  source: /note="Description of Artificial Sequence: Synthetic oligonucleotide"
ucagggggcccagggcguc

SEQ ID NO: 575 - RNA, 19 nt, Artificial Sequence
  source: /note="Description of Artificial Sequence: Synthetic oligonucleotide"
agaaggcccgcugcagggg

SEQ ID NO: 576 - RNA, 19 nt, Artificial Sequence
  source: /note="Description of Artificial Sequence: Synthetic oligonucleotide"
acguccagccagaaggccc

SEQ ID NO: 577 - RNA, 19 nt, Artificial Sequence
  source: /note="Description of Artificial Sequence: Synthetic oligonucleotide"
ugguugugcgagacgucca

SEQ ID NO: 578 - RNA, 19 nt, Artificial Sequence
  source: /note="Description of Artificial Sequence: Synthetic oligonucleotide"
aaugccuccaggcgguugu

SEQ ID NO: 579 - RNA, 19 nt, Artificial Sequence
  source: /note="Description of Artificial Sequence: Synthetic oligonucleotide"
ugcuguugggcaaugccuc

SEQ ID NO: 580 - RNA, 19 nt, Artificial Sequence
  source: /note="Description of Artificial Sequence: Synthetic oligonucleotide"
uggugccaagaggcuguug

SEQ ID NO: 581 - RNA, 19 nt, Artificial Sequence
  source: /note="Description of Artificial Sequence: Synthetic oligonucleotide"
uccgccccaguggugccaa

SEQ ID NO: 582 - RNA, 19 nt, Artificial Sequence
  source: /note="Description of Artificial Sequence: Synthetic oligonucleotide"
agguagcgcagccgcccca

SEQ ID NO: 583 - RNA, 19 nt, Artificial Sequence
  source: /note="Description of Artificial Sequence: Synthetic oligonucleotide"
uccugaggcugagguagcg

SEQ ID NO: 584 - RNA, 19 nt, Artificial Sequence
  source: /note="Description of Artificial Sequence: Synthetic oligonucleotide"
ugcagugaguuguuccuga

SEQ ID NO: 585 - RNA, 19 nt, Artificial Sequence
  source: /note="Description of Artificial Sequence: Synthetic oligonucleotide"
ugugaagguccgcagugag

SEQ ID NO: 586 - RNA, 19 nt, Artificial Sequence
  source: /note="Description of Artificial Sequence: Synthetic oligonucleotide"
ugggcugcggcgugaaggu

SEQ ID NO: 587 - RNA, 19 nt, Artificial Sequence
  source: /note="Description of Artificial Sequence: Synthetic oligonucleotide"
ucuccaggcccgggggcug

SEQ ID NO: 588 - RNA, 19 nt, Artificial Sequence
  source: /note="Description of Artificial Sequence: Synthetic oligonucleotide"
agccacaggcgcuccaggc

SEQ ID NO: 589 - RNA, 19 nt, Artificial Sequence
  source: /note="Description of Artificial Sequence: Synthetic oligonucleotide"
uguuacccuccagccacag

SEQ ID NO: 590 - RNA, 19 nt, Artificial Sequence
  source: /note="Description of Artificial Sequence: Synthetic oligonucleotide"
uacagucccagggguuacc

SEQ ID NO: 591 - RNA, 19 nt, Artificial Sequence
  source: /note="Description of Artificial Sequence: Synthetic oligonucleotide"
agagggcagccacaguccc

SEQ ID NO: 592 - RNA, 19 nt, Artificial Sequence
  source: /note="Description of Artificial Sequence: Synthetic oligonucleotide"
ucagcgccuugagagggca

SEQ ID NO: 593 - RNA, 19 nt, Artificial Sequence
  source: /note="Description of Artificial Sequence: Synthetic oligonucleotide"
agggcgaagucccgcagcg

SEQ ID NO: 594 - RNA, 19 nt, Artificial Sequence
  source: /note="Description of Artificial Sequence: Synthetic oligonucleotide"
ugggguucugcagggcgaa

SEQ ID NO: 595 - RNA, 19 nt, Artificial Sequence
  source: /note="Description of Artificial Sequence: Synthetic oligonucleotide"
ucacagcacugggguucug

SEQ ID NO: 596 - RNA, 19 nt, Artificial Sequence
  source: /note="Description of Artificial Sequence: Synthetic oligonucleotide"
uacgaagcggggcacagca

SEQ ID NO: 597 - RNA, 19 nt, Artificial Sequence
  source: /note="Description of Artificial Sequence: Synthetic oligonucleotide"
acagauggccuggacgaag

SEQ ID NO: 598 - RNA, 19 nt, Artificial Sequence
  source: /note="Description of Artificial Sequence: Synthetic oligonucleotide"
aucgucccccucacagaug

SEQ ID NO: 599 - RNA, 19 nt, Artificial Sequence
  source: /note="Description of Artificial Sequence: Synthetic oligonucleotide"
ucggcuggcaaucgucccc

SEQ ID NO: 600 - RNA, 19 nt, Artificial Sequence
  source: /note="Description of Artificial Sequence: Synthetic oligonucleotide"
agguguacgcgggcggcug

SEQ ID NO: 601 - RNA, 19 nt, Artificial Sequence
  source: /note="Description of Artificial Sequence: Synthetic oligonucleotide"
auguuguuguagguguacg

SEQ ID NO: 602 - RNA, 19 nt, Artificial Sequence
  source: /note="Description of Artificial Sequence: Synthetic oligonucleotide"
uggcacaggugauguuguu

SEQ ID NO: 603 - RNA, 19 nt, Artificial Sequence
  source: /note="Description of Artificial Sequence: Synthetic oligonucleotide"
ucucgggcgggcuggcaca

SEQ ID NO: 604 - RNA, 19 nt, Artificial Sequence
  source: /note="Description of Artificial Sequence: Synthetic oligonucleotide"
agccccacgaccucgggcg

SEQ ID NO: 605 - RNA, 19 nt, Artificial Sequence
  source: /note="Description of Artificial Sequence: Synthetic oligonucleotide"
ucgcaggucgagccccacg

SEQ ID NO: 606 - RNA, 19 nt, Artificial Sequence
  source: /note="Description of Artificial Sequence: Synthetic oligonucleotide"
ucgcugaggucccgcaggu

SEQ ID NO: 607 - RNA, 19 nt, Artificial Sequence
  source: /note="Description of Artificial Sequence: Synthetic oligonucleotide"
ucaaagugggccucgcuga

SEQ ID NO: 608 - RNA, 19 nt, Artificial Sequence
  source: /note="Description of Artificial Sequence: Synthetic oligonucleotide"
ugucagcagggagcaaagu

SEQ ID NO: 609 - RNA, 19 nt, Artificial Sequence
  source: /note="Description of Artificial Sequence: Synthetic oligonucleotide"
uggggaccuggucagcagg

SEQ ID NO: 610 - RNA, 19 nt, Artificial Sequence
  source: /note="Description of Artificial Sequence: Synthetic oligonucleotide"
uggggcuugaguccgggga

SEQ ID NO: 611 - RNA, 19 nt, Artificial Sequence
  source: /note="Description of Artificial Sequence: Synthetic oligonucleotide"
ugccugaguccggggcuug

SEQ ID NO: 612 - RNA, 19 nt, Artificial Sequence
  source: /note="Description of Artificial Sequence: Synthetic oligonucleotide"
uagccaggugggggccuga

SEQ ID NO: 613 - RNA, 19 nt, Artificial Sequence
  source: /note="Description of Artificial Sequence: Synthetic oligonucleotide"
agcacaaggugagccaggu

SEQ ID NO: 614 - RNA, 19 nt, Artificial Sequence
  source: /note="Description of Artificial Sequence: Synthetic oligonucleotide"
ugaccuguccccagcacaa

SEQ ID NO: 615 - RNA, 19 nt, Artificial Sequence
  source: /note="Description of Artificial Sequence: Synthetic oligonucleotide"
aggacacugaggaccuguc

SEQ ID NO: 616 - RNA, 19 nt, Artificial Sequence
  source: /note="Description of Artificial Sequence: Synthetic oligonucleotide"
uaggccccugaggacacug

SEQ ID NO: 617 - RNA, 19 nt, Artificial Sequence
  source: /note="Description of Artificial Sequence: Synthetic oligonucleotide"
aagugcacugggcaggccc

SEQ ID NO: 618 - RNA, 19 nt, Artificial Sequence
  source: /note="Description of Artificial Sequence: Synthetic oligonucleotide"
ucgucuuccagcaagugca

SEQ ID NO: 619 - RNA, 19 nt, Artificial Sequence
  source: /note="Description of Artificial Sequence: Synthetic oligonucleotide"
uaggcccuugcgucuucca

SEQ ID NO: 620 - RNA, 19 nt, Artificial Sequence
  source: /note="Description of Artificial Sequence: Synthetic oligonucleotide"
uuccaccccaucaggcccu

SEQ ID NO: 621 - RNA, 19 nt, Artificial Sequence
  source: /note="Description of Artificial Sequence: Synthetic oligonucleotide"
uccgccaugccuuccaccc

SEQ ID NO: 622 - RNA, 19 nt, Artificial Sequence
  source: /note="Description of Artificial Sequence: Synthetic oligonucleotide"
acagcugggggggccgcca

SEQ ID NO: 623 - RNA, 19 nt, Artificial Sequence
  source: /note="Description of Artificial Sequence: Synthetic oligonucleotide"
cuuuaauugaugacagcug

SEQ ID NO: 624 - RNA, 19 nt, Artificial Sequence
  source: /note="Description of Artificial Sequence: Synthetic oligonucleotide"
auugccuuugccuuuaauu

SEQ ID NO: 625 - RNA, 19 nt, Artificial Sequence
  source: /note="Description of Artificial Sequence: Synthetic oligonucleotide"
uuuuagauucgauugccuu

SEQ ID NO: 626 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcagggguggccggcatt

SEQ ID NO: 627 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccggcacagcagacguacatt

SEQ ID NO: 628 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacguacccucccucgcutt

SEQ ID NO: 629 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccucgcugccugccugatt

SEQ ID NO: 630 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccugcagccugcccugatt

SEQ ID NO: 631 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccugcaugcaggaugatt

SEQ ID NO: 632 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggauggcccugaggaaagtt

SEQ ID NO: 633 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaggaaaggaggccugatt

SEQ ID NO: 634 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccuggcccuggcgcuatt

SEQ ID NO: 635 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgcugcugcugcuguccutt

SEQ ID NO: 636 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuguccuggguggcacutt

SEQ ID NO: 637 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcacugggcccccgcaatt

SEQ ID NO: 638 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcccccgcagccuggaggatt

SEQ ID NO: 639 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggagggagcagaccccgatt

SEQ ID NO: 640 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaccccggaacgccgggatt

SEQ ID NO: 641 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgccgggggaagccgaggatt

SEQ ID NO: 642 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgagggcccagcgugcccatt

SEQ ID NO: 643 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgugcccggccgccugutt

SEQ ID NO: 644 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccugugucugcagcuacatt

SEQ ID NO: 645 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcagcuacgaugacgacatt

SEQ ID NO: 646 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacgacgcggaugagcucatt

SEQ ID NO: 647 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augagcucagcgucuucuatt

SEQ ID NO: 648 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucugcagcuccaggaatt

SEQ ID NO: 649 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaggaaccucacgcgcatt

SEQ ID NO: 650 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacgcgccugccugaugatt

SEQ ID NO: 651 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauggagucccgggcggatt

SEQ ID NO: 652 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgggcggcacccaagcccutt

SEQ ID NO: 653 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagcccuguggcuggacatt

SEQ ID NO: 654 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcuggacggcaacaacatt

SEQ ID NO: 655 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaaccucucguccgucatt

SEQ ID NO: 656 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccguccccccggcagccutt

SEQ ID NO: 657 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggcagccuuccagaaccutt

SEQ ID NO: 658 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaaccucuccagccugatt

SEQ ID NO: 659 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccugggcuuccucaacatt

SEQ ID NO: 660 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccucaaccugcagggcatt

SEQ ID NO: 661 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagggcggccagcugggcatt

SEQ ID NO: 662 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugggcagccuggagcatt

SEQ ID NO: 663 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggagccacaggcgcugatt

SEQ ID NO: 664 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcugcugggccuagagaatt

SEQ ID NO: 665 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuagagaaccugugccacatt

SEQ ID NO: 666 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugccaccugcaccuggatt

SEQ ID NO: 667 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accuggagcggaaccagcutt

SEQ ID NO: 668 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccagcugcgcagccugatt

SEQ ID NO: 669 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcagccuggcacucggcatt

SEQ ID NO: 670 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggcacguuugcacacaatt

SEQ ID NO: 671 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcacacacgcccgcgcutt

SEQ ID NO: 672 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccgcgcuggccucgcucatt

SEQ ID NO: 673 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcucggccucagcaacatt

SEQ ID NO: 674 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaacaaccgucugagcatt

SEQ ID NO: 675 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggaggacgggcucuucatt

SEQ ID NO: 676 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuucgagggccucggcatt

SEQ ID NO: 677 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccucggcagccucuggatt

SEQ ID NO: 678 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugggaccucaaccucgatt

SEQ ID NO: 679 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccucggcuggaauagcatt

SEQ ID NO: 680 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaauagccuggcggugatt

SEQ ID NO: 681 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggugcuccccgaugcggatt

SEQ ID NO: 682 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaugcggcguuccgcggcatt

SEQ ID NO: 683 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccgcggccugggcagcatt

SEQ ID NO: 684 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagccugcgcgagcuggutt

SEQ ID NO: 685 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagcuggugcuggcgggcatt

SEQ ID NO: 686 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggcgggcaacaggcugatt

SEQ ID NO: 687 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcuggccuaccugcagatt

SEQ ID NO: 688 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accugcagcccgcgcucuutt

SEQ ID NO: 689 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcucuucagcggccuggatt

SEQ ID NO: 690 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggccuggccgagcuccgatt

SEQ ID NO: 691 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuccgggagcuggaccutt

SEQ ID NO: 692 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggaccugagcaggaacatt

SEQ ID NO: 693 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaacgcgcugcgggccatt

SEQ ID NO: 694 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgggccaucaaggcaaacatt

SEQ ID NO: 695 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggcaaacguguucgugatt

SEQ ID NO: 696 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgugcagcugccccggatt

SEQ ID NO: 697 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaacucuaccuggaccatt

SEQ ID NO: 698 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuggaccgcaaccucauatt

SEQ ID NO: 699 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucaucgcugccguggcatt

SEQ ID NO: 700 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguggccccgggcgccuuatt

SEQ ID NO: 701 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcgccuuccugggccugatt

SEQ ID NO: 702 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggccugaaggcgcugcatt

SEQ ID NO: 703 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcugcgauggcuggaccutt

SEQ ID NO: 704 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaccugucccacaaccatt

SEQ ID NO: 705 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacaaccgcguggcuggcatt

SEQ ID NO: 706 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcuggccuccuggaggatt

SEQ ID NO: 707 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuggaggacacguucccatt

SEQ ID NO: 708 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccccggucugcugggcatt

SEQ ID NO: 709 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugggccugcgugugcutt

SEQ ID NO: 710 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgugugcugcggcuguccatt

SEQ ID NO: 711 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugucccacaacgccaucatt

SEQ ID NO: 712 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacgccaucgccagccugatt

SEQ ID NO: 713 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccugcggccccgcaccutt

SEQ ID NO: 714 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcaccuucaaggaccugatt

SEQ ID NO: 715 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggaccugcacuuccugatt

SEQ ID NO: 716 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccuggaggagcugcagatt

SEQ ID NO: 717 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcagcugggccacaacatt

SEQ ID NO: 718 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacaaccgcauccggcaatt

SEQ ID NO: 719 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccggcagcuggcugagcatt

SEQ ID NO: 720 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcugagcgcagcuuugatt

SEQ ID NO: 721 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuuugagggccuggggatt

SEQ ID NO: 722 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggcagcuugaggugcutt

SEQ ID NO: 723 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaggugcucacgcuagatt

SEQ ID NO: 724 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgcuagaccacaaccagatt

SEQ ID NO: 725 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccagcuccaggaggucatt

SEQ ID NO: 726 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaggucaaggcgggcgatt

SEQ ID NO: 727 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgggcgcuuuccucggccutt

SEQ ID NO: 728 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucggccucaccaacgugatt

SEQ ID NO: 729 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacguggcggucaugaacatt

SEQ ID NO: 730 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugaaccucucugggaatt

SEQ ID NO: 731 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugggaacugucuccggatt

SEQ ID NO: 732 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccggaaccuuccggaatt

SEQ ID NO: 733 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccggagcagguguuccatt

SEQ ID NO: 734 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguguuccggggccugggatt

SEQ ID NO: 735 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugggcaagcugcacagcatt

SEQ ID NO: 736 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcacagccugcaccuggatt

SEQ ID NO: 737 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcugccugggacgcauatt

SEQ ID NO: 738 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacgcauccgcccgcacaatt

SEQ ID NO: 739 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcacaccuucaccggccutt

SEQ ID NO: 740 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccggccucucggggcutt

SEQ ID NO: 741 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggggcuccgccgacucutt

SEQ ID NO: 742 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgacucuuccucaaggacatt

SEQ ID NO: 743 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaggacaacggccucguatt

SEQ ID NO: 744 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccucgugggcauugagatt

SEQ ID NO: 745 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaggagcagagccuguatt

SEQ ID NO: 746 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagccugugggggcuggatt

SEQ ID NO: 747 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcuggcggagcugcugatt

SEQ ID NO: 748 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuggagcucgaccugaatt

SEQ ID NO: 749 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaccugaccuccaaccagatt

SEQ ID NO: 750 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaaccagcucacgcacatt

SEQ ID NO: 751 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgcaccugccccaccgcatt

SEQ ID NO: 752 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccgccucuuccagggcatt

SEQ ID NO: 753 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagggccugggcaagcutt

SEQ ID NO: 754 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaagcuggaguaccugcutt

SEQ ID NO: 755 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccugcugcucucccgcatt

SEQ ID NO: 756 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucucccgcaaccgccugatt

SEQ ID NO: 757 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgccuggcagagcugccatt

SEQ ID NO: 758 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugccggcggacgcccutt

SEQ ID NO: 759 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacgcccugggcccccugatt

SEQ ID NO: 760 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccccugcagcgggccuucutt

SEQ ID NO: 761 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggccuucuggcuggacgutt

SEQ ID NO: 762 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacgucucgcacaaccatt

SEQ ID NO: 763 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaccgccuggaggcauutt

SEQ ID NO: 764 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggcauugcccaacagcatt

SEQ ID NO: 765 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacagccucuuggcaccatt

SEQ ID NO: 766 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggcaccacuggggcggatt

SEQ ID NO: 767 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggcggcugcgcuaccutt

SEQ ID NO: 768 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcuaccucagccucaggatt

SEQ ID NO: 769 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggaacaacucacugcatt

SEQ ID NO: 770 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucacugcggaccuucacatt

SEQ ID NO: 771 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accuucacgccgcagcccatt

SEQ ID NO: 772 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcccccgggccuggagatt

SEQ ID NO: 773 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccuggagcgccuguggcutt

SEQ ID NO: 774 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguggcuggaggguaacatt

SEQ ID NO: 775 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguaaccccugggacuguatt

SEQ ID NO: 776 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggacuguggcugcccucutt

SEQ ID NO: 777 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccucucaaggcgcugatt

SEQ ID NO: 778 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcugcgggacuucgcccutt

SEQ ID NO: 779 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgcccugcagaaccccatt

SEQ ID NO: 780 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaaccccagugcugugatt

SEQ ID NO: 781 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugugccccgcuucguatt

SEQ ID NO: 782 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucguccaggccaucugutt

SEQ ID NO: 783 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucugugagggggacgautt

SEQ ID NO: 784 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggacgauugccagccgatt

SEQ ID NO: 785 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagccgcccgcguacaccutt

SEQ ID NO: 786 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguacaccuacaacaacautt

SEQ ID NO: 787 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaacaucaccugugccatt

SEQ ID NO: 788 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugccagcccgcccgagatt

SEQ ID NO: 789 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcccgaggucguggggcutt

SEQ ID NO: 790 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguggggcucgaccugcgatt

SEQ ID NO: 791 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accugcgggaccucagcgatt

SEQ ID NO: 792 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcgaggcccacuuugatt

SEQ ID NO: 793 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuugcucccugcugacatt

SEQ ID NO: 794 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugcugaccagguccccatt

SEQ ID NO: 795 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccccggacucaagccccatt

SEQ ID NO: 796 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagccccggacucaggcatt

SEQ ID NO: 797 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggcccccaccuggcuatt

SEQ ID NO: 798 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accuggcucaccuugugcutt

SEQ ID NO: 799 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugcuggggacaggucatt

SEQ ID NO: 800 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacagguccucaguguccutt

SEQ ID NO: 801 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguguccucaggggccuatt

SEQ ID NO: 802 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggccugcccagugcacuutt

SEQ ID NO: 803 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcacuugcuggaagacgatt

SEQ ID NO: 804 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaagacgcaagggccuatt

SEQ ID NO: 805 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggccugaugggguggaatt

SEQ ID NO: 806 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggguggaaggcauggcggatt

SEQ ID NO: 807 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcggcccccccagcugutt

SEQ ID NO: 808 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcugucaucaauuaaagtt

SEQ ID NO: 809 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuaaaggcaaaggcaautt

SEQ ID NO: 810 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggcaaucgaaucuaaaatt

SEQ ID NO: 811 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccggccaccccugcccutt

SEQ ID NO: 812 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguacgucugcugugccggtt

SEQ ID NO: 813 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgagggaggguacgucutt

SEQ ID NO: 814 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggcaggcagcgagggatt

SEQ ID NO: 815 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagggcaggcugcaggcatt

SEQ ID NO: 816 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauccugcaugcagggcatt

SEQ ID NO: 817 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuccucagggccauccutt

SEQ ID NO: 818 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggccuccuuuccucagtt

SEQ ID NO: 819 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcgccagggccaggccutt

SEQ ID NO: 820 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacagcagcagcagcgctt

SEQ ID NO: 821 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugccacccaggacagcatt

SEQ ID NO: 822 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcgggggcccagugccatt

SEQ ID NO: 823 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuccaggcugcgggggctt

SEQ ID NO: 824 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggggucugcucccuccatt

SEQ ID NO: 825 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccggcguuccggggucutt

SEQ ID NO: 826 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccucggcuucccccggcgtt

SEQ ID NO: 827 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggcacgcugggcccucgtt

SEQ ID NO: 828 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaggcggccgggcacgcutt

SEQ ID NO: 829 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguagcugcagacacaggctt

SEQ ID NO: 830 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgucaucguagcugcatt

SEQ ID NO: 831 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagcucauccgcgucguctt

SEQ ID NO: 832 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagaagacgcugagcucautt

SEQ ID NO: 833 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccuggagcugcagaagatt

SEQ ID NO: 834 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgcgugagguuccuggatt

SEQ ID NO: 835 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucaggcaggcgcgugatt

SEQ ID NO: 836 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgcccgggacuccaucatt

SEQ ID NO: 837 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcuugggugccgcccgtt

SEQ ID NO: 838 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguccagccacagggcuugtt

SEQ ID NO: 839 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuguugccguccagccatt

SEQ ID NO: 840 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacggacgagagguuguutt

SEQ ID NO: 841 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcugccggggggacggatt

SEQ ID NO: 842 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguucuggaaggcugccgtt

SEQ ID NO: 843 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggcuggagagguucugtt

SEQ ID NO: 844 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguugaggaagcccaggcutt

SEQ ID NO: 845 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccugcagguugaggaatt

SEQ ID NO: 846 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccagcuggccgcccugtt

SEQ ID NO: 847 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuccaggcugcccagcutt

SEQ ID NO: 848 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcgccuguggcuccagtt

SEQ ID NO: 849 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucuaggcccagcagcgtt

SEQ ID NO: 850 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguggcacagguucucuagtt

SEQ ID NO: 851 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaggugcagguggcacatt

SEQ ID NO: 852 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugguuccgcuccaggutt

SEQ ID NO: 853 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggcugcgcagcugguutt

SEQ ID NO: 854 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccgagugccaggcugcgtt

SEQ ID NO: 855 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugugcaaacgugccgatt

SEQ ID NO: 856 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgcgggcgugugugcaatt

SEQ ID NO: 857 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagcgaggccagcgcgggtt

SEQ ID NO: 858 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguugcugaggccgagcgatt

SEQ ID NO: 859 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucagacgguuguugcutt

SEQ ID NO: 860 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagagcccguccuccagtt

SEQ ID NO: 861 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccgaggcccucgaagagtt

SEQ ID NO: 862 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagaggcugccgaggcctt

SEQ ID NO: 863 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgagguugaggucccagatt

SEQ ID NO: 864 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuauuccagccgagguutt

SEQ ID NO: 865 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccgccaggcuauuccatt

SEQ ID NO: 866 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgcaucggggagcaccgtt

SEQ ID NO: 867 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccgcggaacgccgcauctt

SEQ ID NO: 868 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugcccaggccgcggaatt

SEQ ID NO: 869 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accagcucgcgcaggcugctt

SEQ ID NO: 870 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccgccagcaccagcuctt

SEQ ID NO: 871 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagccuguugcccgccagtt

SEQ ID NO: 872 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcagguaggccagccutt

SEQ ID NO: 873 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagcgcgggcugcaggutt

SEQ ID NO: 874 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaggccgcugaagagcgtt

SEQ ID NO: 875 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggagcucggccaggccgtt

SEQ ID NO: 876 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguccagcucccggagcutt

SEQ ID NO: 877 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuccugcucagguccagtt

SEQ ID NO: 878 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcccgcagcgcguuccutt

SEQ ID NO: 879 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuugccuugauggcccgtt

SEQ ID NO: 880 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacgaacacguuugccuutt

SEQ ID NO: 881 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccggggcagcugcacgaatt

SEQ ID NO: 882 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguccagguagaguuucutt

SEQ ID NO: 883 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugagguugcgguccaggtt

SEQ ID NO: 884 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccacggcagcgaugaggtt

SEQ ID NO: 885 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaggcgcccggggccacgtt

SEQ ID NO: 886 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggcccaggaaggcgcctt

SEQ ID NO: 887 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcagcgccuucaggcccatt

SEQ ID NO: 888 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguccagccaucgcagcgtt

SEQ ID NO: 889 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguugugggacagguccatt

SEQ ID NO: 890 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccagccacgcgguugugtt

SEQ ID NO: 891 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuccaggaggccagccatt

SEQ ID NO: 892 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggaacguguccuccaggtt

SEQ ID NO: 893 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccagcagaccggggaatt

SEQ ID NO: 894 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcacacgcaggcccagcatt

SEQ ID NO: 895 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacagccgcagcacacgtt

SEQ ID NO: 896 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauggcguugugggacagtt

SEQ ID NO: 897 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggcuggcgauggcguutt

SEQ ID NO: 898 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggugcggggccgcaggcutt

SEQ ID NO: 899 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagguccuugaaggugcgtt

SEQ ID NO: 900 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggaagugcagguccuutt

SEQ ID NO: 901 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcagcuccuccaggaatt

SEQ ID NO: 902 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuguggcccagcugcagtt

SEQ ID NO: 903 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugccggaugcgguuguggtt

SEQ ID NO: 904 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucagccagcugccggatt

SEQ ID NO: 905 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaagcugcgcucagccatt

SEQ ID NO: 906 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccccaggcccucaaagcutt

SEQ ID NO: 907 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaccucaagcugccccatt

SEQ ID NO: 908 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuagcgugagcaccucaatt

SEQ ID NO: 909 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugguuguggucuagcgutt

SEQ ID NO: 910 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaccuccuggagcugguutt

SEQ ID NO: 911 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcccgccuugaccuccutt

SEQ ID NO: 912 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccgaggaaagcgcccgtt

SEQ ID NO: 913 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacguuggugaggccgagtt

SEQ ID NO: 914 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguucaugaccgccacguutt

SEQ ID NO: 915 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucccagagagguucaugatt

SEQ ID NO: 916 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccggagacaguucccagatt

SEQ ID NO: 917 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccggaagguuccggagatt

SEQ ID NO: 918 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaacaccugcuccggaatt

SEQ ID NO: 919 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccaggccccggaacacctt

SEQ ID NO: 920 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugugcagcuugcccagtt

SEQ ID NO: 921 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaggugcaggcugugcatt

SEQ ID NO: 922 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugcgucccaggcagcugtt

SEQ ID NO: 923 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugcgggcggaugcguctt

SEQ ID NO: 924 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccggugaaggugugcgtt

SEQ ID NO: 925 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccccgagaggccggugatt

SEQ ID NO: 926 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagucggcggagccccgatt

SEQ ID NO: 927 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguccuugaggaagagucgtt

SEQ ID NO: 928 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacgaggccguuguccuugtt

SEQ ID NO: 929 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucaaugcccacgaggcctt

SEQ ID NO: 930 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaggcucugcuccucaatt

SEQ ID NO: 931 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagcccccacaggcucutt

SEQ ID NO: 932 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcagcuccgccagccctt

SEQ ID NO: 933 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaggucgagcuccagcatt

SEQ ID NO: 934 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugguuggaggucagguctt

SEQ ID NO: 935 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugcgugagcugguuggatt

SEQ ID NO: 936 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgguggggcaggugcgutt

SEQ ID NO: 937 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccuggaagaggcggugtt

SEQ ID NO: 938 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuugcccaggcccuggatt

SEQ ID NO: 939 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagguacuccagcuugctt

SEQ ID NO: 940 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgggagagcagcagguatt

SEQ ID NO: 941 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggcgguugcgggagagtt

SEQ ID NO: 942 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcagcucugccaggcggtt

SEQ ID NO: 943 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcguccgccggcagcutt

SEQ ID NO: 944 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagggggcccagggcguctt

SEQ ID NO: 945 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaggcccgcugcaggggtt

SEQ ID NO: 946 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acguccagccagaaggccctt

SEQ ID NO: 947 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguugugcgagacguccatt

SEQ ID NO: 948 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugccuccaggcgguugutt

SEQ ID NO: 949 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuguugggcaaugccuctt

SEQ ID NO: 950 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugccaagaggcuguugtt

SEQ ID NO: 951 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgccccaguggugccaatt

SEQ ID NO: 952 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguagcgcagccgccccatt

SEQ ID NO: 953 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugaggcugagguagcgtt

SEQ ID NO: 954 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcagugaguuguuccugatt

SEQ ID NO: 955 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaagguccgcagugagtt

SEQ ID NO: 956 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggcugcggcgugaaggutt

SEQ ID NO: 957 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccaggcccgggggcugtt

SEQ ID NO: 958 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccacaggcgcuccaggctt

SEQ ID NO: 959 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuacccuccagccacagtt

SEQ ID NO: 960 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacagucccagggguuacctt

SEQ ID NO: 961 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagggcagccacaguccctt

SEQ ID NO: 962 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcgccuugagagggcatt

SEQ ID NO: 963 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcgaagucccgcagcgtt

SEQ ID NO: 964 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggguucugcagggcgaatt

SEQ ID NO: 965 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacagcacugggguucugtt

SEQ ID NO: 966 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacgaagcggggcacagcatt

SEQ ID NO: 967 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagauggccuggacgaagtt

SEQ ID NO: 968 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucgucccccucacagaugtt

SEQ ID NO: 969 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggcuggcaaucgucccctt

SEQ ID NO: 970 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguguacgcgggcggcugtt

SEQ ID NO: 971 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuguuguagguguacgtt

SEQ ID NO: 972 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcacaggugauguuguutt

SEQ ID NO: 973 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucgggcgggcuggcacatt

SEQ ID NO: 974 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccccacgaccucgggcgtt

SEQ ID NO: 975 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcaggucgagccccacgtt

SEQ ID NO: 976 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcugaggucccgcaggutt

SEQ ID NO: 977 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaagugggccucgcugatt

SEQ ID NO: 978 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucagcagggagcaaagutt

SEQ ID NO: 979 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggaccuggucagcaggtt

SEQ ID NO: 980 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggcuugaguccggggatt

SEQ ID NO: 981 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccugaguccggggcuugtt

SEQ ID NO: 982 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagccaggugggggccugatt

SEQ ID NO: 983 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcacaaggugagccaggutt

SEQ ID NO: 984 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaccuguccccagcacaatt

SEQ ID NO: 985 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacacugaggaccuguctt

SEQ ID NO: 986 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggccccugaggacacugtt

SEQ ID NO: 987 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagugcacugggcaggccctt

SEQ ID NO: 988 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgucuuccagcaagugcatt

SEQ ID NO: 989 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggcccuugcgucuuccatt

SEQ ID NO: 990 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccaccccaucaggcccutt

SEQ ID NO: 991 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgccaugccuuccaccctt

SEQ ID NO: 992 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagcugggggggccgccatt

SEQ ID NO: 993 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuaauugaugacagcugtt

SEQ ID NO: 994 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugccuuugccuuuaauutt

SEQ ID NO: 995 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuagauucgauugccuutt

SEQ ID NO: 996 - RNA, 19 nt, Artificial Sequence
  source: /note="Description of Artificial Sequence: Synthetic oligonucleotide"
agggcagggguggccggca

SEQ ID NO: 997 - RNA, 19 nt, Artificial Sequence
  source: /note="Description of Artificial Sequence: Synthetic oligonucleotide"
ccggcacagcagacguacc

SEQ ID NO: 998 - RNA, 19 nt, Artificial Sequence
  source: /note="Description of Artificial Sequence: Synthetic oligonucleotide"
agacguacccucccucgcu

SEQ ID NO: 999 - RNA, 19 nt, Artificial Sequence
  source: /note="Description of Artificial Sequence: Synthetic oligonucleotide"
ucccucgcugccugccugc

SEQ ID NO: 1000 - RNA, 19 nt, Artificial Sequence
  source: /note="Description of Artificial Sequence: Synthetic oligonucleotide"
ugccugcagccugcccugc

SEQ ID NO: 1001 - RNA, 19 nt, Artificial Sequence
  source: /note="Description of Artificial Sequence: Synthetic oligonucleotide"
ugcccugcaugcaggaugg

SEQ ID NO: 1002 - RNA, 19 nt, Artificial Sequence
  source: /note="Description of Artificial Sequence: Synthetic oligonucleotide"
aggauggcccugaggaaag

SEQ ID NO: 1003 - RNA, 19 nt, Artificial Sequence
  source: /note="Description of Artificial Sequence: Synthetic oligonucleotide"
cugaggaaaggaggccugg

SEQ ID NO: 1004 - RNA, 19 nt, Artificial Sequence
  source: /note="Description of Artificial Sequence: Synthetic oligonucleotide"
aggccuggcccuggcgcug

SEQ ID NO: 1005 - RNA, 19 nt, Artificial Sequence
  source: /note="Description of Artificial Sequence: Synthetic oligonucleotide"
gcgcugcugcugcuguccu

SEQ ID NO: 1006 - RNA, 19 nt, Artificial Sequence
  source: /note="Description of Artificial Sequence: Synthetic oligonucleotide"
ugcuguccuggguggcacu

SEQ ID NO: 1007 - RNA, 19 nt, Artificial Sequence
  source: /note="Description of Artificial Sequence: Synthetic oligonucleotide"
uggcacugggcccccgcag

SEQ ID NO: 1008 - RNA, 19 nt, Artificial Sequence
  source: /note="Description of Artificial Sequence: Synthetic oligonucleotide"
gcccccgcagccuggaggg

SEQ ID NO: 1009 - RNA, 19 nt, Artificial Sequence
  source: /note="Description of Artificial Sequence: Synthetic oligonucleotide"
uggagggagcagaccccgg

SEQ ID NO: 1010 - RNA, 19 nt, Artificial Sequence
  source: /note="Description of Artificial Sequence: Synthetic oligonucleotide"
agaccccggaacgccgggg

SEQ ID NO: 1011 - RNA, 19 nt, Artificial Sequence
  source: /note="Description of Artificial Sequence: Synthetic oligonucleotide"
cgccgggggaagccgaggg

SEQ ID NO: 1012 - RNA, 19 nt, Artificial Sequence
  source: /note="Description of Artificial Sequence: Synthetic oligonucleotide"
cgagggcccagcgugcccg

SEQ ID NO: 1013 - RNA, 19 nt, Artificial Sequence
  source: /note="Description of Artificial Sequence: Synthetic oligonucleotide"
agcgugcccggccgccugu

SEQ ID NO: 1014 - RNA, 19 nt, Artificial Sequence
  source: /note="Description of Artificial Sequence: Synthetic oligonucleotide"
gccugugucugcagcuacg

SEQ ID NO: 1015 - RNA, 19 nt, Artificial Sequence
  source: /note="Description of Artificial Sequence: Synthetic oligonucleotide"
ugcagcuacgaugacgacg

SEQ ID NO: 1016 - RNA, 19 nt, Artificial Sequence
  source: /note="Description of Artificial Sequence: Synthetic oligonucleotide"
gacgacgcggaugagcuca

SEQ ID NO: 1017 - RNA, 19 nt, Artificial Sequence
  source: /note="Description of Artificial Sequence: Synthetic oligonucleotide"
augagcucagcgucuucug

SEQ ID NO: 1018 - RNA, 19 nt, Artificial Sequence
  source: /note="Description of Artificial Sequence: Synthetic oligonucleotide"
ucuucugcagcuccaggaa

SEQ ID NO: 1019 - RNA, 19 nt, Artificial Sequence
  source: /note="Description of Artificial Sequence: Synthetic oligonucleotide"
uccaggaaccucacgcgcc

SEQ ID NO: 1020 - RNA, 19 nt, Artificial Sequence
  source: /note="Description of Artificial Sequence: Synthetic oligonucleotide"
ucacgcgccugccugaugg

SEQ ID NO: 1021 - RNA, 19 nt, Artificial Sequence
  source: /note="Description of Artificial Sequence: Synthetic oligonucleotide"
ugauggagucccgggcggc

SEQ ID NO: 1022 - RNA, 19 nt, Artificial Sequence
  source: /note="Description of Artificial Sequence: Synthetic oligonucleotide"
cgggcggcacccaagcccu

SEQ ID NO: 1023 - RNA, 19 nt, Artificial Sequence
  source: /note="Description of Artificial Sequence: Synthetic oligonucleotide"
caagcccuguggcuggacg

SEQ ID NO: 1024 - RNA, 19 nt, Artificial Sequence
  source: /note="Description of Artificial Sequence: Synthetic oligonucleotide"
uggcuggacggcaacaacc

SEQ ID NO: 1025 - RNA, 19 nt, Artificial Sequence
  source: /note="Description of Artificial Sequence: Synthetic oligonucleotide"
aacaaccucucguccgucc

SEQ ID NO: 1026 - RNA, 19 nt, Artificial Sequence
  source: /note="Description of Artificial Sequence: Synthetic oligonucleotide"
uccguccccccggcagccu

SEQ ID NO: 1027 - RNA, 19 nt, Artificial Sequence
  source: /note="Description of Artificial Sequence: Synthetic oligonucleotide"
cggcagccuuccagaaccu

SEQ ID NO: 1028 - RNA, 19 nt, Artificial Sequence
  source: /note="Description of Artificial Sequence: Synthetic oligonucleotide"
cagaaccucuccagccugg

SEQ ID NO: 1029 - RNA, 19 nt, Artificial Sequence
  source: /note="Description of Artificial Sequence: Synthetic oligonucleotide"
agccugggcuuccucaacc

SEQ ID NO: 1030 - RNA, 19 nt, Artificial Sequence
  source: /note="Description of Artificial Sequence: Synthetic oligonucleotide"
uuccucaaccugcagggcg

SEQ ID NO: 1031 - RNA, 19 nt, Artificial Sequence
  source: /note="Description of Artificial Sequence: Synthetic oligonucleotide"
cagggcggccagcugggca

SEQ ID NO: 1032 - RNA, 19 nt, Artificial Sequence
  source: /note="Description of Artificial Sequence: Synthetic oligonucleotide"
agcugggcagccuggagcc

SEQ ID NO: 1033 - RNA, 19 nt, Artificial Sequence
  source: /note="Description of Artificial Sequence: Synthetic oligonucleotide"
cuggagccacaggcgcugc

SEQ ID NO: 1034 - RNA, 19 nt, Artificial Sequence
  source: /note="Description of Artificial Sequence: Synthetic oligonucleotide"
cgcugcugggccuagagaa

SEQ ID NO: 1035 - RNA, 19 nt, Artificial Sequence
  source: /note="Description of Artificial Sequence: Synthetic oligonucleotide"
cuagagaaccugugccacc

SEQ ID NO: 1036 - RNA, 19 nt, Artificial Sequence
  source: /note="Description of Artificial Sequence: Synthetic oligonucleotide"
ugugccaccugcaccugga

SEQ ID NO: 1037 - RNA, 19 nt, Artificial Sequence
  source: /note="Description of Artificial Sequence: Synthetic oligonucleotide"
accuggagcggaaccagcu

SEQ ID NO: 1038 - RNA, 19 nt, Artificial Sequence
  source: /note="Description of Artificial Sequence: Synthetic oligonucleotide"
aaccagcugcgcagccugg

SEQ ID NO: 1039 - RNA, 19 nt, Artificial Sequence
  source: /note="Description of Artificial Sequence: Synthetic oligonucleotide"
cgcagccuggcacucggca

SEQ ID NO: 1040 - RNA, 19 nt, Artificial Sequence
  source: /note="Description of Artificial Sequence: Synthetic oligonucleotide"
ucggcacguuugcacacac

SEQ ID NO: 1041 - RNA, 19 nt, Artificial Sequence
  source: /note="Description of Artificial Sequence: Synthetic oligonucleotide"
uugcacacacgcccgcgcu

SEQ ID NO: 1042 - RNA, 19 nt, Artificial Sequence
  source: /note="Description of Artificial Sequence: Synthetic oligonucleotide"
cccgcgcuggccucgcucg

SEQ ID NO: 1043 - RNA, 19 nt, Artificial Sequence
  source: /note="Description of Artificial Sequence: Synthetic oligonucleotide"
ucgcucggccucagcaaca

SEQ ID NO: 1044 - RNA, 19 nt, Artificial Sequence
  source: /note="Description of Artificial Sequence: Synthetic oligonucleotide"
agcaacaaccgucugagca

SEQ ID NO: 1045 - RNA, 19 nt, Artificial Sequence
  source: /note="Description of Artificial Sequence: Synthetic oligonucleotide"
cuggaggacgggcucuucg

SEQ ID NO: 1046 - RNA, 19 nt, Artificial Sequence
  source: /note="Description of Artificial Sequence: Synthetic oligonucleotide"
cucuucgagggccucggca

SEQ ID NO: 1047 - RNA, 19 nt, Artificial Sequence
  source: /note="Description of Artificial Sequence: Synthetic oligonucleotide"
ggccucggcagccucuggg

SEQ ID NO: 1048 - RNA, 19 nt, Artificial Sequence
  source: /note="Description of Artificial Sequence: Synthetic oligonucleotide"
ucugggaccucaaccucgg

SEQ ID NO: 1049 - RNA, 19 nt, Artificial Sequence
  source: /note="Description of Artificial Sequence: Synthetic oligonucleotide"
aaccucggcuggaauagcc

SEQ ID NO: 1050 - RNA, 19 nt, Artificial Sequence
  source: /note="Description of Artificial Sequence: Synthetic oligonucleotide"
uggaauagccuggcggugc

SEQ ID NO: 1051 - RNA, 19 nt, Artificial Sequence
  source: /note="Description of Artificial Sequence: Synthetic oligonucleotide"
cggugcuccccgaugcggc

SEQ ID NO: 1052 - RNA, 19 nt, Artificial Sequence
  source: /note="Description of Artificial Sequence: Synthetic oligonucleotide"
gaugcggcguuccgcggcc

SEQ ID NO: 1053 - RNA, 19 nt, Artificial Sequence
  source: /note="Description of Artificial Sequence: Synthetic oligonucleotide"
uuccgcggccugggcagcc

SEQ ID NO: 1054 - RNA, 19 nt, Artificial Sequence
  source: /note="Description of Artificial Sequence: Synthetic oligonucleotide"
gcagccugcgcgagcuggu

SEQ ID NO: 1055 - RNA, 19 nt, Artificial Sequence
  source: /note="Description of Artificial Sequence: Synthetic oligonucleotide"
gagcuggugcuggcgggca

SEQ ID NO: 1056 - RNA, 19 nt, Artificial Sequence
  source: /note="Description of Artificial Sequence: Synthetic oligonucleotide"
cuggcgggcaacaggcugg

SEQ ID NO: 1057 - RNA, 19 nt, Artificial Sequence
  source: /note="Description of Artificial Sequence: Synthetic oligonucleotide"
aggcuggccuaccugcagc

SEQ ID NO: 1058 - RNA, 19 nt, Artificial Sequence
  source: /note="Description of Artificial Sequence: Synthetic oligonucleotide"
accugcagcccgcgcucuu

SEQ ID NO: 1059 - RNA, 19 nt, Artificial Sequence
  source: /note="Description of Artificial Sequence: Synthetic oligonucleotide"
cgcucuucagcggccuggc

SEQ ID NO: 1060 - RNA, 19 nt, Artificial Sequence
  source: /note="Description of Artificial Sequence: Synthetic oligonucleotide"
cggccuggccgagcuccgg

SEQ ID NO: 1061 - RNA, 19 nt, Artificial Sequence
  source: /note="Description of Artificial Sequence: Synthetic oligonucleotide"
agcuccgggagcuggaccu

SEQ ID NO: 1062 - RNA, 19 nt, Artificial Sequence
  source: /note="Description of Artificial Sequence: Synthetic oligonucleotide"
cuggaccugagcaggaacg

SEQ ID NO: 1063 - RNA, 19 nt, Artificial Sequence
  source: /note="Description of Artificial Sequence: Synthetic oligonucleotide"
aggaacgcgcugcgggcca

SEQ ID NO: 1064 - RNA, 19 nt, Artificial Sequence
  source: /note="Description of Artificial Sequence: Synthetic oligonucleotide"
cgggccaucaaggcaaacg

SEQ ID NO: 1065 - RNA, 19 nt, Artificial Sequence
  source: /note="Description of Artificial Sequence: Synthetic oligonucleotide"
aaggcaaacguguucgugc

SEQ ID NO: 1066 - RNA, 19 nt, Artificial Sequence
  source: /note="Description of Artificial Sequence: Synthetic oligonucleotide"
uucgugcagcugccccggc

SEQ ID NO: 1067 - RNA, 19 nt, Artificial Sequence
  source: /note="Description of Artificial Sequence: Synthetic oligonucleotide"
agaaacucuaccuggaccg

SEQ ID NO: 1068 - RNA, 19 nt, Artificial Sequence
  source: /note="Description of Artificial Sequence: Synthetic oligonucleotide"
ccuggaccgcaaccucauc

SEQ ID NO: 1069 - RNA, 19 nt, Artificial Sequence
  source: /note="Description of Artificial Sequence: Synthetic oligonucleotide"
ccucaucgcugccguggcc

SEQ ID NO: 1070 - RNA, 19 nt, Artificial Sequence
  source: /note="Description of Artificial Sequence: Synthetic oligonucleotide"
cguggccccgggcgccuuc

SEQ ID NO: 1071 - RNA, 19 nt, Artificial Sequence
  source: /note="Description of Artificial Sequence: Synthetic oligonucleotide"
ggcgccuuccugggccuga

SEQ ID NO: 1072 - RNA, 19 nt, Artificial Sequence
  source: /note="Description of Artificial Sequence: Synthetic oligonucleotide"
ugggccugaaggcgcugcg

SEQ ID NO: 1073 - RNA, 19 nt, Artificial Sequence
  source: /note="Description of Artificial Sequence: Synthetic oligonucleotide"
cgcugcgauggcuggaccu

SEQ ID NO: 1074 - RNA, 19 nt, Artificial Sequence
  source: /note="Description of Artificial Sequence: Synthetic oligonucleotide"
uggaccugucccacaaccg

SEQ ID NO: 1075 - RNA, 19 nt, Artificial Sequence
  source: /note="Description of Artificial Sequence: Synthetic oligonucleotide"
cacaaccgcguggcuggcc

SEQ ID NO: 1076 - RNA, 19 nt, Artificial Sequence
  source: /note="Description of Artificial Sequence: Synthetic oligonucleotide"
uggcuggccuccuggagga

SEQ ID NO: 1077 - RNA, 19 nt, Artificial Sequence
  source: /note="Description of Artificial Sequence: Synthetic oligonucleotide"
ccuggaggacacguucccc

SEQ ID NO: 1078 - RNA, 19 nt, Artificial Sequence
  source: /note="Description of Artificial Sequence: Synthetic oligonucleotide"
uuccccggucugcugggcc

SEQ ID NO: 1079 - RNA, 19 nt, Artificial Sequence
  source: /note="Description of Artificial Sequence: Synthetic oligonucleotide"
ugcugggccugcgugugcu

SEQ ID NO: 1080 - RNA, 19 nt, Artificial Sequence
  source: /note="Description of Artificial Sequence: Synthetic oligonucleotide"
cgugugcugcggcuguccc

SEQ ID NO: 1081 - RNA, 19 nt, Artificial Sequence
  source: /note="Description of Artificial Sequence: Synthetic oligonucleotide"
cugucccacaacgccaucg

SEQ ID NO: 1082 - RNA, 19 nt, Artificial Sequence
  source: /note="Description of Artificial Sequence: Synthetic oligonucleotide"
aacgccaucgccagccugc

SEQ ID NO: 1083 - RNA, 19 nt, Artificial Sequence
  source: /note="Description of Artificial Sequence: Synthetic oligonucleotide"
agccugcggccccgcaccu

SEQ ID NO: 1084 - RNA, 19 nt, Artificial Sequence
  source: /note="Description of Artificial Sequence: Synthetic oligonucleotide"
cgcaccuucaaggaccugc

SEQ ID NO: 1085 - RNA, 19 nt, Artificial Sequence
  source: /note="Description of Artificial Sequence: Synthetic oligonucleotide"
aaggaccugcacuuccugg

SEQ ID NO: 1086 - RNA, 19 nt, Artificial Sequence
  source: /note="Description of Artificial Sequence: Synthetic oligonucleotide"
uuccuggaggagcugcagc

SEQ ID NO: 1087 - RNA, 19 nt, Artificial Sequence
  source: /note="Description of Artificial Sequence: Synthetic oligonucleotide"
cugcagcugggccacaacc

SEQ ID NO: 1088 - RNA, 19 nt, Artificial Sequence
  source: /note="Description of Artificial Sequence: Synthetic oligonucleotide"
ccacaaccgcauccggcag

SEQ ID NO: 1089 - RNA, 19 nt, Artificial Sequence
  source: /note="Description of Artificial Sequence: Synthetic oligonucleotide"
uccggcagcuggcugagcg

SEQ ID NO: 1090 - RNA, 19 nt, Artificial Sequence
  source: /note="Description of Artificial Sequence: Synthetic oligonucleotide"
uggcugagcgcagcuuuga

SEQ ID NO: 1091 - RNA, 19 nt, Artificial Sequence
  source: /note="Description of Artificial Sequence: Synthetic oligonucleotide"
agcuuugagggccuggggc

SEQ ID NO: 1092 - RNA, 19 nt, Artificial Sequence
  source: /note="Description of Artificial Sequence: Synthetic oligonucleotide"
uggggcagcuugaggugcu

SEQ ID NO: 1093 - RNA, 19 nt, Artificial Sequence
  source: /note="Description of Artificial Sequence: Synthetic oligonucleotide"
uugaggugcucacgcuaga

SEQ ID NO: 1094 - RNA, 19 nt, Artificial Sequence
  source: /note="Description of Artificial Sequence: Synthetic oligonucleotide"
acgcuagaccacaaccagc

SEQ ID NO: 1095 - RNA, 19 nt, Artificial Sequence
  source: /note="Description of Artificial Sequence: Synthetic oligonucleotide"
aaccagcuccaggagguca

SEQ ID NO: 1096 - RNA, 19 nt, Artificial Sequence
  source: /note="Description of Artificial Sequence: Synthetic oligonucleotide"
aggaggucaaggcgggcgc

SEQ ID NO: 1097 - RNA, 19 nt, Artificial Sequence
  source: /note="Description of Artificial Sequence: Synthetic oligonucleotide"
cgggcgcuuuccucggccu

SEQ ID NO: 1098 - RNA, 19 nt, Artificial Sequence
  source: /note="Description of Artificial Sequence: Synthetic oligonucleotide"
cucggccucaccaacgugg

SEQ ID NO: 1099 - RNA, 19 nt, Artificial Sequence
  source: /note="Description of Artificial Sequence: Synthetic oligonucleotide"
aacguggcggucaugaacc

SEQ ID NO: 1100 - RNA, 19 nt, Artificial Sequence
  source: /note="Description of Artificial Sequence: Synthetic oligonucleotide"
ucaugaaccucucugggaa

SEQ ID NO: 1101 - RNA, 19 nt, Artificial Sequence
  source: /note="Description of Artificial Sequence: Synthetic oligonucleotide"
ucugggaacugucuccgga

SEQ ID NO: 1102 - RNA, 19 nt, Artificial Sequence
  source: /note="Description of Artificial Sequence: Synthetic oligonucleotide"
ucuccggaaccuuccggag

SEQ ID NO: 1103 - RNA, 19 nt, Artificial Sequence
  source: /note="Description of Artificial Sequence: Synthetic oligonucleotide"
uuccggagcagguguuccg

SEQ ID NO: 1104 - RNA, 19 nt, Artificial Sequence
  source: /note="Description of Artificial Sequence: Synthetic oligonucleotide"
gguguuccggggccugggc

SEQ ID NO: 1105 - RNA, 19 nt, Artificial Sequence
  source: /note="Description of Artificial Sequence: Synthetic oligonucleotide"
cugggcaagcugcacagcc

SEQ ID NO: 1106 - RNA, 19 nt, Artificial Sequence
  source: /note="Description of Artificial Sequence: Synthetic oligonucleotide"
ugcacagccugcaccugga

SEQ ID NO: 1107 - RNA, 19 nt, Artificial Sequence
  source: /note="Description of Artificial Sequence: Synthetic oligonucleotide"
cagcugccugggacgcauc

SEQ ID NO: 1108 - RNA, 19 nt, Artificial Sequence
  source: /note="Description of Artificial Sequence: Synthetic oligonucleotide"
gacgcauccgcccgcacac

SEQ ID NO: 1109 - RNA, 19 nt, Artificial Sequence
  source: /note="Description of Artificial Sequence: Synthetic oligonucleotide"
cgcacaccuucaccggccu

SEQ ID NO: 1110 - RNA, 19 nt, Artificial Sequence
  source: /note="Description of Artificial Sequence: Synthetic oligonucleotide"
ucaccggccucucggggcu

SEQ ID NO: 1111 - RNA, 19 nt, Artificial Sequence
  source: /note="Description of Artificial Sequence: Synthetic oligonucleotide"
ucggggcuccgccgacucu

SEQ ID NO: 1112 - RNA, 19 nt, Artificial Sequence
  source: /note="Description of Artificial Sequence: Synthetic oligonucleotide"
cgacucuuccucaaggaca

SEQ ID NO: 1113 - RNA, 19 nt, Artificial Sequence
  source: /note="Description of Artificial Sequence: Synthetic oligonucleotide"
caaggacaacggccucgug

SEQ ID NO: 1114 - RNA, 19 nt, Artificial Sequence
  source: /note="Description of Artificial Sequence: Synthetic oligonucleotide"
ggccucgugggcauugagg

SEQ ID NO: 1115 - RNA, 19 nt, Artificial Sequence
  source: /note="Description of Artificial Sequence: Synthetic oligonucleotide"
uugaggagcagagccugug

SEQ ID NO: 1116 - RNA, 19 nt, Artificial Sequence
  source: /note="Description of Artificial Sequence: Synthetic oligonucleotide"
agagccugugggggcuggc

SEQ ID NO: 1117 - RNA, 19 nt, Artificial Sequence
  source: /note="Description of Artificial Sequence: Synthetic oligonucleotide"
gggcuggcggagcugcugg

SEQ ID NO: 1118 - RNA, 19 nt, Artificial Sequence
  source: /note="Description of Artificial Sequence: Synthetic oligonucleotide"
ugcuggagcucgaccugac

SEQ ID NO: 1119 - RNA, 19 nt, Artificial Sequence
  source: /note="Description of Artificial Sequence: Synthetic oligonucleotide"
gaccugaccuccaaccagc

SEQ ID NO: 1120 - RNA, 19 nt, Artificial Sequence
  source: /note="Description of Artificial Sequence: Synthetic oligonucleotide"
uccaaccagcucacgcacc

SEQ ID NO: 1121 - RNA, 19 nt, Artificial Sequence
  source: /note="Description of Artificial Sequence: Synthetic oligonucleotide"
acgcaccugccccaccgcc

SEQ ID NO: 1122 - RNA, 19 nt, Artificial Sequence
  source: /note="Description of Artificial Sequence: Synthetic oligonucleotide"
caccgccucuuccagggcc

SEQ ID NO: 1123 - RNA, 19 nt, Artificial Sequence
  source: /note="Description of Artificial Sequence: Synthetic oligonucleotide"
uccagggccugggcaagcu

SEQ ID NO: 1124 - RNA, 19 nt, Artificial Sequence
  source: /note="Description of Artificial Sequence: Synthetic oligonucleotide"
gcaagcuggaguaccugcu

SEQ ID NO: 1125 - RNA, 19 nt, Artificial Sequence
  source: /note="Description of Artificial Sequence: Synthetic oligonucleotide"
uaccugcugcucucccgca

SEQ ID NO: 1126 - RNA, 19 nt, Artificial Sequence
  source: /note="Description of Artificial Sequence: Synthetic oligonucleotide"
cucucccgcaaccgccugg

SEQ ID NO: 1127 - RNA, 19 nt, Artificial Sequence
  source: /note="Description of Artificial Sequence: Synthetic oligonucleotide"
ccgccuggcagagcugccg

SEQ ID NO: 1128 - RNA, 19 nt, Artificial Sequence
  source: /note="Description of Artificial Sequence: Synthetic oligonucleotide"
agcugccggcggacgcccu

SEQ ID NO: 1129 - RNA, 19 nt, Artificial Sequence
  source: /note="Description of Artificial Sequence: Synthetic oligonucleotide"
gacgcccugggcccccugc

SEQ ID NO: 1130 - RNA, 19 nt, Artificial Sequence
  source: /note="Description of Artificial Sequence: Synthetic oligonucleotide"
ccccugcagcgggccuucu

SEQ ID NO: 1131 - RNA, 19 nt, Artificial Sequence
  source: /note="Description of Artificial Sequence: Synthetic oligonucleotide"
gggccuucuggcuggacgu

SEQ ID NO: 1132 - RNA, 19 nt, Artificial Sequence
  source: /note="Description of Artificial Sequence: Synthetic oligonucleotide"
uggacgucucgcacaaccg

SEQ ID NO: 1133 - RNA, 19 nt, Artificial Sequence
  source: /note="Description of Artificial Sequence: Synthetic oligonucleotide"
acaaccgccuggaggcauu

SEQ ID NO: 1134 - RNA, 19 nt, Artificial Sequence
  source: /note="Description of Artificial Sequence: Synthetic oligonucleotide"
gaggcauugcccaacagcc

SEQ ID NO: 1135 - RNA, 19 nt, Artificial Sequence
  source: /note="Description of Artificial Sequence: Synthetic oligonucleotide"
caacagccucuuggcacca

SEQ ID NO: 1136 - RNA, 19 nt, Artificial Sequence
  source: /note="Description of Artificial Sequence: Synthetic oligonucleotide"
uuggcaccacuggggcggc

SEQ ID NO: 1137 - RNA, 19 nt, Artificial Sequence
  source: /note="Description of Artificial Sequence: Synthetic oligonucleotide"
uggggcggcugcgcuaccu

SEQ ID NO: 1138 - RNA, 19 nt, Artificial Sequence
  source: /note="Description of Artificial Sequence: Synthetic oligonucleotide"
cgcuaccucagccucagga

SEQ ID NO: 1139 - RNA, 19 nt, Artificial Sequence
  source: /note="Description of Artificial Sequence: Synthetic oligonucleotide"
ucaggaacaacucacugcg

SEQ ID NO: 1140 - RNA, 19 nt, Artificial Sequence
  source: /note="Description of Artificial Sequence: Synthetic oligonucleotide"
cucacugcggaccuucacg

SEQ ID NO: 1141 - RNA, 19 nt, Artificial Sequence
  source: /note="Description of Artificial Sequence: Synthetic oligonucleotide"
accuucacgccgcagcccc

SEQ ID NO: 1142 - RNA, 19 nt, Artificial Sequence
  source: /note="Description of Artificial Sequence: Synthetic oligonucleotide"
cagcccccgggccuggagc

SEQ ID NO: 1143 - RNA, 19 nt, Artificial Sequence
  source: /note="Description of Artificial Sequence: Synthetic oligonucleotide"
gccuggagcgccuguggcu

SEQ ID NO: 1144 - RNA, 19 nt, Artificial Sequence
  source: /note="Description of Artificial Sequence: Synthetic oligonucleotide"
cuguggcuggaggguaacc

SEQ ID NO: 1145 - RNA, 19 nt, Artificial Sequence
  source: /note="Description of Artificial Sequence: Synthetic oligonucleotide"
gguaaccccugggacugug

SEQ ID NO: 1146 - RNA, 19 nt, Artificial Sequence
  source: /note="Description of Artificial Sequence: Synthetic oligonucleotide"
gggacuguggcugcccucu

SEQ ID NO: 1147 - RNA, 19 nt, Artificial Sequence
  source: /note="Description of Artificial Sequence: Synthetic oligonucleotide"
ugcccucucaaggcgcugc

SEQ ID NO: 1148 - RNA, 19 nt, Artificial Sequence
  source: /note="Description of Artificial Sequence: Synthetic oligonucleotide"
cgcugcgggacuucgcccu

SEQ ID NO: 1149 - RNA, 19 nt, Artificial Sequence
  source: /note="Description of Artificial Sequence: Synthetic oligonucleotide"
uucgcccugcagaacccca

SEQ ID NO: 1150 - RNA, 19 nt, Artificial Sequence
  source: /note="Description of Artificial Sequence: Synthetic oligonucleotide"
cagaaccccagugcugugc

SEQ ID NO: 1151 - RNA, 19 nt, Artificial Sequence
  source: /note="Description of Artificial Sequence: Synthetic oligonucleotide"
ugcugugccccgcuucguc

SEQ ID NO: 1152 - RNA, 19 nt, Artificial Sequence
  source: /note="Description of Artificial Sequence: Synthetic oligonucleotide"
cuucguccaggccaucugu

SEQ ID NO: 1153 - RNA, 19 nt, Artificial Sequence
  source: /note="Description of Artificial Sequence: Synthetic oligonucleotide"
caucugugagggggacgau

SEQ ID NO: 1154 - RNA, 19 nt, Artificial Sequence
  source: /note="Description of Artificial Sequence: Synthetic oligonucleotide"
ggggacgauugccagccgc

SEQ ID NO: 1155 - RNA, 19 nt, Artificial Sequence
  source: /note="Description of Artificial Sequence: Synthetic oligonucleotide"
cagccgcccgcguacaccu

SEQ ID NO: 1156 - RNA, 19 nt, Artificial Sequence
  source: /note="Description of Artificial Sequence: Synthetic oligonucleotide"
cguacaccuacaacaacau

SEQ ID NO: 1157 - RNA, 19 nt, Artificial Sequence
  source: /note="Description of Artificial Sequence: Synthetic oligonucleotide"
aacaacaucaccugugcca

SEQ ID NO: 1158 - RNA, 19 nt, Artificial Sequence
  source: /note="Description of Artificial Sequence: Synthetic oligonucleotide"
ugugccagcccgcccgagg

SEQ ID NO: 1159 - RNA, 19 nt, Artificial Sequence
  source: /note="Description of Artificial Sequence: Synthetic oligonucleotide"
cgcccgaggucguggggcu

SEQ ID NO: 1160 - RNA, 19 nt, Artificial Sequence
  source: /note="Description of Artificial Sequence: Synthetic oligonucleotide"
cguggggcucgaccugcgg

SEQ ID NO: 1161 - RNA, 19 nt, Artificial Sequence
  source: /note="Description of Artificial Sequence: Synthetic oligonucleotide"
accugcgggaccucagcga

SEQ ID NO: 1162 - RNA, 19 nt, Artificial Sequence
  source: /note="Description of Artificial Sequence: Synthetic oligonucleotide"
ucagcgaggcccacuuugc

SEQ ID NO: 1163 - RNA, 19 nt, Artificial Sequence
  source: /note="Description of Artificial Sequence: Synthetic oligonucleotide"
acuuugcucccugcugacc

SEQ ID NO: 1164 - RNA, 19 nt, Artificial Sequence
  source: /note="Description of Artificial Sequence: Synthetic oligonucleotide"
ccugcugaccagguccccg

SEQ ID NO: 1165 - RNA, 19 nt, Artificial Sequence
  source: /note="Description of Artificial Sequence: Synthetic oligonucleotide"
uccccggacucaagccccg

SEQ ID NO: 1166 - RNA, 19 nt, Artificial Sequence
  source: /note="Description of Artificial Sequence: Synthetic oligonucleotide"
caagccccggacucaggcc

SEQ ID NO: 1167 - RNA, 19 nt, Artificial Sequence
  source: /note="Description of Artificial Sequence: Synthetic oligonucleotide"
ucaggcccccaccuggcuc

SEQ ID NO: 1168 - RNA, 19 nt, Artificial Sequence
  source: /note="Description of Artificial Sequence: Synthetic oligonucleotide"
accuggcucaccuugugcu

SEQ ID NO: 1169 - RNA, 19 nt, Artificial Sequence
  source: /note="Description of Artificial Sequence: Synthetic oligonucleotide"
uugugcuggggacaggucc

SEQ ID NO: 1170 - RNA, 19 nt, Artificial Sequence
  source: /note="Description of Artificial Sequence: Synthetic oligonucleotide"
gacagguccucaguguccu

SEQ ID NO: 1171 - RNA, 19 nt, Artificial Sequence
  source: /note="Description of Artificial Sequence: Synthetic oligonucleotide"
caguguccucaggggccug

SEQ ID NO: 1172 - RNA, 19 nt, Artificial Sequence
  source: /note="Description of Artificial Sequence: Synthetic oligonucleotide"
gggccugcccagugcacuu

SEQ ID NO: 1173 - RNA, 19 nt, Artificial Sequence
  source: /note="Description of Artificial Sequence: Synthetic oligonucleotide"
ugcacuugcuggaagacgc

SEQ ID NO: 1174 - RNA, 19 nt, Artificial Sequence
  source: /note="Description of Artificial Sequence: Synthetic oligonucleotide"
uggaagacgcaagggccug

SEQ ID NO: 1175 - RNA, 19 nt, Artificial Sequence
  source: /note="Description of Artificial Sequence: Synthetic oligonucleotide"
agggccugaugggguggaa

SEQ ID NO: 1176 - RNA, 19 nt, Artificial Sequence
  source: /note="Description of Artificial Sequence: Synthetic oligonucleotide"
ggguggaaggcauggcggc

SEQ ID NO: 1177 - RNA, 19 nt, Artificial Sequence
  source: /note="Description of Artificial Sequence: Synthetic oligonucleotide"
uggcggcccccccagcugu

SEQ ID NO: 1178 - RNA, 19 nt, Artificial Sequence
  source: /note="Description of Artificial Sequence: Synthetic oligonucleotide"
cagcugucaucaauuaaag

SEQ ID NO: 1179 - RNA, 19 nt, Artificial Sequence
  source: /note="Description of Artificial Sequence: Synthetic oligonucleotide"
aauuaaaggcaaaggcaau

SEQ ID NO: 1180 - RNA, 19 nt, Artificial Sequence
  source: /note="Description of Artificial Sequence: Synthetic oligonucleotide"
aaggcaaucgaaucuaaaa

SEQ ID NO: 1181 - RNA, 21 nt, Artificial Sequence
  source: /note="Description of Artificial Sequence: Synthetic oligonucleotide"
gcugcuuccggagcugugaua

SEQ ID NO: 1182 - RNA, 21 nt, Artificial Sequence
  source: /note="Description of Artificial Sequence: Synthetic oligonucleotide"
ucugcggggcugagcugguga

SEQ ID NO: 1183 - RNA, 21 nt, Artificial Sequence
  source: /note="Description of Artificial Sequence: Synthetic oligonucleotide"
ccugcucaccuucaccagcua

SEQ ID NO: 1184 - RNA, 21 nt, Artificial Sequence
  source: /note="Description of Artificial Sequence: Synthetic oligonucleotide"
guggagacaggggcuuuuauu

SEQ ID NO: 1185 - RNA, 21 nt, Artificial Sequence
  source: /note="Description of Artificial Sequence: Synthetic oligonucleotide"
uggagacaggggcuuuuauuu

SEQ ID NO: 1186 - RNA, 21 nt, Artificial Sequence
  source: /note="Description of Artificial Sequence: Synthetic oligonucleotide"
gagacaggggcuuuuauuuca

SEQ ID NO: 1187 - RNA, 21 nt, Artificial Sequence
  source: /note="Description of Artificial Sequence: Synthetic oligonucleotide"
cauguccuccucgcaucucuu

SEQ ID NO: 1188 - RNA, 21 nt, Artificial Sequence
  source: /note="Description of Artificial Sequence: Synthetic oligonucleotide"
uuuuauuucaacaagcccaca

SEQ ID NO: 1189 - RNA, 21 nt, Artificial Sequence
  source: /note="Description of Artificial Sequence: Synthetic oligonucleotide"
uguggagacaggggcuuuuau

SEQ ID NO: 1190 - RNA, 21 nt, Artificial Sequence
  source: /note="Description of Artificial Sequence: Synthetic oligonucleotide"
uggaugagugcugcuuccgga

SEQ ID NO: 1191 - RNA, 21 nt, Artificial Sequence
  source: /note="Description of Artificial Sequence: Synthetic oligonucleotide"
ucguguguggagacaggggcu

SEQ ID NO: 1192 - RNA, 21 nt, Artificial Sequence
  source: /note="Description of Artificial Sequence: Synthetic oligonucleotide"
gauguauugcgcaccccucaa

SEQ ID NO: 1193 - RNA, 21 nt, Artificial Sequence
  source: /note="Description of Artificial Sequence: Synthetic oligonucleotide"
uucaguucguguguggagaca

SEQ ID NO: 1194 - RNA, 21 nt, Artificial Sequence
  source: /note="Description of Artificial Sequence: Synthetic oligonucleotide"
cuccucgcaucucuucuaccu

SEQ ID NO: 1195 - RNA, 21 nt, Artificial Sequence
  source: /note="Description of Artificial Sequence: Synthetic oligonucleotide"
agauguauugcgcaccccuca

SEQ ID NO: 1196 - RNA, 21 nt, Artificial Sequence
  source: /note="Description of Artificial Sequence: Synthetic oligonucleotide"
gccacaccgacaugcccaaga

SEQ ID NO: 1197 - RNA, 21 nt, Artificial Sequence
  source: /note="Description of Artificial Sequence: Synthetic oligonucleotide"
ggagauguauugcgcaccccu

SEQ ID NO: 1198 - RNA, 21 nt, Artificial Sequence
  source: /note="Description of Artificial Sequence: Synthetic oligonucleotide"
uucaacaagcccacaggguau

SEQ ID NO: 1199 - RNA, 21 nt, Artificial Sequence
  source: /note="Description of Artificial Sequence: Synthetic oligonucleotide"
ugcccagcgccacaccgacau

SEQ ID NO: 1200 - RNA, 21 nt, Artificial Sequence
  source: /note="Description of Artificial Sequence: Synthetic oligonucleotide"
gcaucguggaugagugcugcu

SEQ ID NO: 1201 - RNA, 21 nt, Artificial Sequence
  source: /note="Description of Artificial Sequence: Synthetic oligonucleotide"
ggagacaggggcuuuuauuua

SEQ ID NO: 1202 - RNA, 21 nt, Artificial Sequence
  source: /note="Description of Artificial Sequence: Synthetic oligonucleotide"
gggcuuuuauuucaacaagca

SEQ ID NO: 1203 - RNA, 21 nt, Artificial Sequence
  source: /note="Description of Artificial Sequence: Synthetic oligonucleotide"
ucguggaugagugcugcuuca

SEQ ID NO: 1204 - RNA, 21 nt, Artificial Sequence
  source: /note="Description of Artificial Sequence: Synthetic oligonucleotide"
uccucgcaucucuucuaccua

SEQ ID NO: 1205 - RNA, 21 nt, Artificial Sequence
  source: /note="Description of Artificial Sequence: Synthetic oligonucleotide"
ggggcuuuuauuucaacaaga

SEQ ID NO: 1206 - RNA, 21 nt, Artificial Sequence
  source: /note="Description of Artificial Sequence: Synthetic oligonucleotide"
uuuauuucaacaagcccacaa

SEQ ID NO: 1207 - RNA, 21 nt, Artificial Sequence
  source: /note="Description of Artificial Sequence: Synthetic oligonucleotide"
gcuggagauguauugcgcaca

SEQ ID NO: 1208 - RNA, 21 nt, Artificial Sequence
  source: /note="Description of Artificial Sequence: Synthetic oligonucleotide"
ggguauggcuccagcagucga

SEQ ID NO: 1209 - RNA, 21 nt, Artificial Sequence
  source: /note="Description of Artificial Sequence: Synthetic oligonucleotide"
cuggagauguauugcgcacca

SEQ ID NO: 1210 - RNA, 21 nt, Artificial Sequence
  source: /note="Description of Artificial Sequence: Synthetic oligonucleotide"
gaagaugcacaccauguccua

SEQ ID NO: 1211 - RNA, 21 nt, Artificial Sequence
  source: /note="Description of Artificial Sequence: Synthetic oligonucleotide"
gaugcucuucaguucgugugu

SEQ ID NO: 1212 - RNA, 21 nt, Artificial Sequence
  source: /note="Description of Artificial Sequence: Synthetic oligonucleotide"
uggaugcucuucaguucgugu

SEQ ID NO: 1213 - RNA, 21 nt, Artificial Sequence
  source: /note="Description of Artificial Sequence: Synthetic oligonucleotide"
gguggaugcucuucaguucgu

SEQ ID NO: 1214 - RNA, 21 nt, Artificial Sequence
  source: /note="Description of Artificial Sequence: Synthetic oligonucleotide"
ugagcugguggaugcucuuca

SEQ ID NO: 1215 - RNA, 21 nt, Artificial Sequence
  source: /note="Description of Artificial Sequence: Synthetic oligonucleotide"
gcugguggaugcucuucaguu

SEQ ID NO: 1216 - RNA, 21 nt, Artificial Sequence
  source: /note="Description of Artificial Sequence: Synthetic oligonucleotide"
ggaugcucuucaguucgugua

SEQ ID NO: 1217 - RNA, 21 nt, Artificial Sequence
  source: /note="Description of Artificial Sequence: Synthetic oligonucleotide"
cugguggaugcucuucaguua

SEQ ID NO: 1218 - RNA, 21 nt, Artificial Sequence
  source: /note="Description of Artificial Sequence: Synthetic oligonucleotide"
ggcugagcugguggaugcucu

SEQ ID NO: 1219 - RNA, 21 nt, Artificial Sequence
  source: /note="Description of Artificial Sequence: Synthetic oligonucleotide"
cugagcugguggaugcucuua

SEQ ID NO: 1220 - RNA, 21 nt, Artificial Sequence
  source: /note="Description of Artificial Sequence: Synthetic oligonucleotide"
cauuguggaugaguguugcuu

SEQ ID NO: 1221 - RNA, 21 nt, Artificial Sequence
  source: /note="Description of Artificial Sequence: Synthetic oligonucleotide"
agauacacaucaugucgucuu

SEQ ID NO: 1222 - RNA, 21 nt, Artificial Sequence
  source: /note="Description of Artificial Sequence: Synthetic oligonucleotide"
uggaugaguguugcuuccgga

SEQ ID NO: 1223 - RNA, 21 nt, Artificial Sequence
  source: /note="Description of Artificial Sequence: Synthetic oligonucleotide"
uguugcuuccggagcugugau

SEQ ID NO: 1224 - RNA, 21 nt, Artificial Sequence
  source: /note="Description of Artificial Sequence: Synthetic oligonucleotide"
gcuuuuacuucaacaagccca

SEQ ID NO: 1225 - RNA, 21 nt, Artificial Sequence
  source: /note="Description of Artificial Sequence: Synthetic oligonucleotide"
augaguguugcuuccggagcu

SEQ ID NO: 1226 - RNA, 21 nt, Artificial Sequence
  source: /note="Description of Artificial Sequence: Synthetic oligonucleotide"
cacacugacaugcccaagacu

SEQ ID NO: 1227 - RNA, 21 nt, Artificial Sequence
  source: /note="Description of Artificial Sequence: Synthetic oligonucleotide"
gcuauggcuccagcauucgga

SEQ ID NO: 1228 - RNA, 21 nt, Artificial Sequence
  source: /note="Description of Artificial Sequence: Synthetic oligonucleotide"
aagauacacaucaugucgucu

SEQ ID NO: 1229 - RNA, 21 nt, Artificial Sequence
  source: /note="Description of Artificial Sequence: Synthetic oligonucleotide"
uugcuuccggagcugugaucu

SEQ ID NO: 1230 - RNA, 21 nt, Artificial Sequence
  source: /note="Description of Artificial Sequence: Synthetic oligonucleotide"
uccggagcugugaucugagga

SEQ ID NO: 1231 - RNA, 21 nt, Artificial Sequence
  source: /note="Description of Artificial Sequence: Synthetic oligonucleotide"
guggaugaguguugcuuccga

SEQ ID NO: 1232 - RNA, 21 nt, Artificial Sequence
  source: /note="Description of Artificial Sequence: Synthetic oligonucleotide"
uacacaucaugucgucuucaa

SEQ ID NO: 1233 - RNA, 21 nt, Artificial Sequence
  source: /note="Description of Artificial Sequence: Synthetic oligonucleotide"
aaagauacacaucaugucgua

SEQ ID NO: 1234 - RNA, 21 nt, Artificial Sequence
  source: /note="Description of Artificial Sequence: Synthetic oligonucleotide"
ggcuauggcuccagcauucga

SEQ ID NO: 1235 - RNA, 21 nt, Artificial Sequence
  source: /note="Description of Artificial Sequence: Synthetic oligonucleotide"
acacugacaugcccaagacua

SEQ ID NO: 1236 - RNA, 21 nt, Artificial Sequence
  source: /note="Description of Artificial Sequence: Synthetic oligonucleotide"
aguguugcuuccggagcugua

SEQ ID NO: 1237 - RNA, 21 nt, Artificial Sequence
  source: /note="Description of Artificial Sequence: Synthetic oligonucleotide"
gagacccuuugcggggcugaa

SEQ ID NO: 1238 - RNA, 21 nt, Artificial Sequence
  source: /note="Description of Artificial Sequence: Synthetic oligonucleotide"
acugacaugcccaagacucaa

SEQ ID NO: 1239 - RNA, 21 nt, Artificial Sequence
  source: /note="Description of Artificial Sequence: Synthetic oligonucleotide"
gauacacaucaugucgucuua

SEQ ID NO: 1240 - RNA, 21 nt, Artificial Sequence
  source: /note="Description of Artificial Sequence: Synthetic oligonucleotide"
aagcccacaggcuauggcuca

SEQ ID NO: 1241 - RNA, 21 nt, Artificial Sequence
  source: /note="Description of Artificial Sequence: Synthetic oligonucleotide"
agauacacaucaugucgucuu

SEQ ID NO: 1242 - RNA, 21 nt, Artificial Sequence
  source: /note="Description of Artificial Sequence: Synthetic oligonucleotide"
aagauacacaucaugucgucu

SEQ ID NO: 1243 - RNA, 21 nt, Artificial Sequence
  source: /note="Description of Artificial Sequence: Synthetic oligonucleotide"
uacacaucaugucgucuucaa

SEQ ID NO: 1244 - RNA, 21 nt, Artificial Sequence
  source: /note="Description of Artificial Sequence: Synthetic oligonucleotide"
aaagauacacaucaugucgua

SEQ ID NO: 1245 - RNA, 21 nt, Artificial Sequence
  source: /note="Description of Artificial Sequence: Synthetic oligonucleotide"
gagacccuuugcggggcugaa

SEQ ID NO: 1246 - RNA, 21 nt, Artificial Sequence
  source: /note="Description of Artificial Sequence: Synthetic oligonucleotide"
gauacacaucaugucgucuua

SEQ ID NO: 1247 - RNA, 23 nt, Artificial Sequence
  source: /note="Description of Artificial Sequence: Synthetic oligonucleotide"
uaucacagcuccggaagcagcac

SEQ ID NO: 1248 - RNA, 23 nt, Artificial Sequence
  source: /note="Description of Artificial Sequence: Synthetic oligonucleotide"
ucaccagcucagccccgcagagc

SEQ ID NO: 1249 - RNA, 23 nt, Artificial Sequence
  source: /note="Description of Artificial Sequence: Synthetic oligonucleotide"
uagcuggugaaggugagcaggca

SEQ ID NO: 1250 - RNA, 23 nt, Artificial Sequence
  source: /note="Description of Artificial Sequence: Synthetic oligonucleotide"
aauaaaagccccugucuccacac

SEQ ID NO: 1251 - RNA, 23 nt, Artificial Sequence
  source: /note="Description of Artificial Sequence: Synthetic oligonucleotide"
aaauaaaagccccugucuccaca

SEQ ID NO: 1252 - RNA, 23 nt, Artificial Sequence
  source: /note="Description of Artificial Sequence: Synthetic oligonucleotide"
ugaaauaaaagccccugucucca

SEQ ID NO: 1253 - RNA, 23 nt, Artificial Sequence
  source: /note="Description of Artificial Sequence: Synthetic oligonucleotide"
aagagaugcgaggaggacauggu

SEQ ID NO: 1254 - RNA, 23 nt, Artificial Sequence
  source: /note="Description of Artificial Sequence: Synthetic oligonucleotide"
ugugggcuuguugaaauaaaagc

SEQ ID NO: 1255 - RNA, 23 nt, Artificial Sequence
  source: /note="Description of Artificial Sequence: Synthetic oligonucleotide"
auaaaagccccugucuccacaca

SEQ ID NO: 1256 - RNA, 23 nt, Artificial Sequence
  source: /note="Description of Artificial Sequence: Synthetic oligonucleotide"
uccggaagcagcacucauccacg

SEQ ID NO: 1257 - RNA, 23 nt, Artificial Sequence
  source: /note="Description of Artificial Sequence: Synthetic oligonucleotide"
agccccugucuccacacacgaac

SEQ ID NO: 1258 - RNA, 23 nt, Artificial Sequence
  source: /note="Description of Artificial Sequence: Synthetic oligonucleotide"
uugaggggugcgcaauacaucuc

SEQ ID NO: 1259 - RNA, 23 nt, Artificial Sequence
  source: /note="Description of Artificial Sequence: Synthetic oligonucleotide"
ugucuccacacacgaacugaaga

SEQ ID NO: 1260 - RNA, 23 nt, Artificial Sequence
  source: /note="Description of Artificial Sequence: Synthetic oligonucleotide"
agguagaagagaugcgaggagga

SEQ ID NO: 1261 - RNA, 23 nt, Artificial Sequence
  source: /note="Description of Artificial Sequence: Synthetic oligonucleotide"
ugaggggugcgcaauacaucucc

SEQ ID NO: 1262 - RNA, 23 nt, Artificial Sequence
  source: /note="Description of Artificial Sequence: Synthetic oligonucleotide"
ucuugggcaugucgguguggcgc

SEQ ID NO: 1263 - RNA, 23 nt, Artificial Sequence
  source: /note="Description of Artificial Sequence: Synthetic oligonucleotide"
aggggugcgcaauacaucuccag

SEQ ID NO: 1264 - RNA, 23 nt, Artificial Sequence
  source: /note="Description of Artificial Sequence: Synthetic oligonucleotide"
auacccugugggcuuguugaaau

SEQ ID NO: 1265 - RNA, 23 nt, Artificial Sequence
  source: /note="Description of Artificial Sequence: Synthetic oligonucleotide"
augucgguguggcgcugggcacg

SEQ ID NO: 1266 - RNA, 23 nt, Artificial Sequence
  source: /note="Description of Artificial Sequence: Synthetic oligonucleotide"
agcagcacucauccacgaugccu

SEQ ID NO: 1267 - RNA, 23 nt, Artificial Sequence
  source: /note="Description of Artificial Sequence: Synthetic oligonucleotide"
uaaauaaaagccccugucuccac

SEQ ID NO: 1268 - RNA, 23 nt, Artificial Sequence
  source: /note="Description of Artificial Sequence: Synthetic oligonucleotide"
ugcuuguugaaauaaaagccccu

SEQ ID NO: 1269 - RNA, 23 nt, Artificial Sequence
  source: /note="Description of Artificial Sequence: Synthetic oligonucleotide"
ugaagcagcacucauccacgaug

SEQ ID NO: 1270 - RNA, 23 nt, Artificial Sequence
  source: /note="Description of Artificial Sequence: Synthetic oligonucleotide"
uagguagaagagaugcgaggagg

SEQ ID NO: 1271 - RNA, 23 nt, Artificial Sequence
  source: /note="Description of Artificial Sequence: Synthetic oligonucleotide"
ucuuguugaaauaaaagccccug

SEQ ID NO: 1272 - RNA, 23 nt, Artificial Sequence
  source: /note="Description of Artificial Sequence: Synthetic oligonucleotide"
uugugggcuuguugaaauaaaag

SEQ ID NO: 1273 - RNA, 23 nt, Artificial Sequence
  source: /note="Description of Artificial Sequence: Synthetic oligonucleotide"
ugugcgcaauacaucuccagccu

SEQ ID NO: 1274 - RNA, 23 nt, Artificial Sequence
  source: /note="Description of Artificial Sequence: Synthetic oligonucleotide"
ucgacugcuggagccauacccug

SEQ ID NO: 1275 - RNA, 23 nt, Artificial Sequence
  source: /note="Description of Artificial Sequence: Synthetic oligonucleotide"
uggugcgcaauacaucuccagcc

SEQ ID NO: 1276 - RNA, 23 nt, Artificial Sequence
  source: /note="Description of Artificial Sequence: Synthetic oligonucleotide"
uaggacauggugugcaucuucac

SEQ ID NO: 1277 - RNA, 23 nt, Artificial Sequence
  source: /note="Description of Artificial Sequence: Synthetic oligonucleotide"
acacacgaacugaagagcaucca

SEQ ID NO: 1278 - RNA, 23 nt, Artificial Sequence
  source: /note="Description of Artificial Sequence: Synthetic oligonucleotide"
acacgaacugaagagcauccacc

SEQ ID NO: 1279 - RNA, 23 nt, Artificial Sequence
  source: /note="Description of Artificial Sequence: Synthetic oligonucleotide"
acgaacugaagagcauccaccag

SEQ ID NO: 1280 - RNA, 23 nt, Artificial Sequence
  source: /note="Description of Artificial Sequence: Synthetic oligonucleotide"
ugaagagcauccaccagcucagc

SEQ ID NO: 1281 - RNA, 23 nt, Artificial Sequence
  source: /note="Description of Artificial Sequence: Synthetic oligonucleotide"
aacugaagagcauccaccagcuc

SEQ ID NO: 1282 - RNA, 23 nt, Artificial Sequence
  source: /note="Description of Artificial Sequence: Synthetic oligonucleotide"
uacacgaacugaagagcauccac

SEQ ID NO: 1283 - RNA, 23 nt, Artificial Sequence
  source: /note="Description of Artificial Sequence: Synthetic oligonucleotide"
uaacugaagagcauccaccagcu

SEQ ID NO: 1284 - RNA, 23 nt, Artificial Sequence
  source: /note="Description of Artificial Sequence: Synthetic oligonucleotide"
agagcauccaccagcucagcccc

SEQ ID NO: 1285 - RNA, 23 nt, Artificial Sequence
  source: /note="Description of Artificial Sequence: Synthetic oligonucleotide"
uaagagcauccaccagcucagcc

SEQ ID NO: 1286 - RNA, 23 nt, Artificial Sequence
  source: /note="Description of Artificial Sequence: Synthetic oligonucleotide"
aagcaacacucauccacaaugcc

SEQ ID NO: 1287 - RNA, 23 nt, Artificial Sequence
  source: /note="Description of Artificial Sequence: Synthetic oligonucleotide"
aagacgacaugauguguaucuuu

SEQ ID NO: 1288 - RNA, 23 nt, Artificial Sequence
  source: /note="Description of Artificial Sequence: Synthetic oligonucleotide"
uccggaagcaacacucauccaca

SEQ ID NO: 1289 - RNA, 23 nt, Artificial Sequence
  source: /note="Description of Artificial Sequence: Synthetic oligonucleotide"
aucacagcuccggaagcaacacu

SEQ ID NO: 1290 - RNA, 23 nt, Artificial Sequence
  source: /note="Description of Artificial Sequence: Synthetic oligonucleotide"
ugggcuuguugaaguaaaagccc

SEQ ID NO: 1291 - RNA, 23 nt, Artificial Sequence
  source: /note="Description of Artificial Sequence: Synthetic oligonucleotide"
agcuccggaagcaacacucaucc

SEQ ID NO: 1292 - RNA, 23 nt, Artificial Sequence
  source: /note="Description of Artificial Sequence: Synthetic oligonucleotide"
agucuugggcaugucaguguggc

SEQ ID NO: 1293 - RNA, 23 nt, Artificial Sequence
  source: /note="Description of Artificial Sequence: Synthetic oligonucleotide"
uccgaaugcuggagccauagccu

SEQ ID NO: 1294 - RNA, 23 nt, Artificial Sequence
  source: /note="Description of Artificial Sequence: Synthetic oligonucleotide"
agacgacaugauguguaucuuua

SEQ ID NO: 1295 - RNA, 23 nt, Artificial Sequence
  source: /note="Description of Artificial Sequence: Synthetic oligonucleotide"
agaucacagcuccggaagcaaca

SEQ ID NO: 1296 - RNA, 23 nt, Artificial Sequence
  source: /note="Description of Artificial Sequence: Synthetic oligonucleotide"
uccucagaucacagcuccggaag

SEQ ID NO: 1297 - RNA, 23 nt, Artificial Sequence
  source: /note="Description of Artificial Sequence: Synthetic oligonucleotide"
ucggaagcaacacucauccacaa

SEQ ID NO: 1298 - RNA, 23 nt, Artificial Sequence
  source: /note="Description of Artificial Sequence: Synthetic oligonucleotide"
uugaagacgacaugauguguauc

SEQ ID NO: 1299 - RNA, 23 nt, Artificial Sequence
  source: /note="Description of Artificial Sequence: Synthetic oligonucleotide"
uacgacaugauguguaucuuuau

SEQ ID NO: 1300 - RNA, 23 nt, Artificial Sequence
  source: /note="Description of Artificial Sequence: Synthetic oligonucleotide"
ucgaaugcuggagccauagccug

SEQ ID NO: 1301 - RNA, 23 nt, Artificial Sequence
  source: /note="Description of Artificial Sequence: Synthetic oligonucleotide"
uagucuugggcaugucagugugg

SEQ ID NO: 1302 - RNA, 23 nt, Artificial Sequence
  source: /note="Description of Artificial Sequence: Synthetic oligonucleotide"
uacagcuccggaagcaacacuca

SEQ ID NO: 1303 - RNA, 23 nt, Artificial Sequence
  source: /note="Description of Artificial Sequence: Synthetic oligonucleotide"
uucagccccgcaaagggucucug

SEQ ID NO: 1304 - RNA, 23 nt, Artificial Sequence
  source: /note="Description of Artificial Sequence: Synthetic oligonucleotide"
uugagucuugggcaugucagugu

SEQ ID NO: 1305 - RNA, 23 nt, Artificial Sequence
  source: /note="Description of Artificial Sequence: Synthetic oligonucleotide"
uaagacgacaugauguguaucuu

SEQ ID NO: 1306 - RNA, 23 nt, Artificial Sequence
  source: /note="Description of Artificial Sequence: Synthetic oligonucleotide"
ugagccauagccugugggcuugu

SEQ ID NO: 1307 - RNA, 23 nt, Artificial Sequence
  source: /note="Description of Artificial Sequence: Synthetic oligonucleotide"
aagacgacaugauguguaucuuu

SEQ ID NO: 1308 - RNA, 23 nt, Artificial Sequence
  source: /note="Description of Artificial Sequence: Synthetic oligonucleotide"
agacgacaugauguguaucuuua

SEQ ID NO: 1309 - RNA, 23 nt, Artificial Sequence
  source: /note="Description of Artificial Sequence: Synthetic oligonucleotide"
uugaagacgacaugauguguauc

SEQ ID NO: 1310 - RNA, 23 nt, Artificial Sequence
  source: /note="Description of Artificial Sequence: Synthetic oligonucleotide"
uacgacaugauguguaucuuuau

SEQ ID NO: 1311 - RNA, 23 nt, Artificial Sequence
  source: /note="Description of Artificial Sequence: Synthetic oligonucleotide"
uucagccccgcaaagggucucug

SEQ ID NO: 1312 - RNA, 23 nt, Artificial Sequence
  source: /note="Description of Artificial Sequence: Synthetic oligonucleotide"
uaagacgacaugauguguaucuu

SEQ ID NO: 1313 - RNA, 21 nt, Artificial Sequence
  source: /note="Description of Artificial Sequence: Synthetic oligonucleotide"
gcugcuuccggagcugugaua

SEQ ID NO: 1314 - RNA, 21 nt, Artificial Sequence
  source: /note="Description of Artificial Sequence: Synthetic oligonucleotide"
ucugcggggcugagcugguga

SEQ ID NO: 1315 - RNA, 21 nt, Artificial Sequence
  source: /note="Description of Artificial Sequence: Synthetic oligonucleotide"
ccugcucaccuucaccagcua

SEQ ID NO: 1316 - RNA, 21 nt, Artificial Sequence
  source: /note="Description of Artificial Sequence: Synthetic oligonucleotide"
guggagacaggggcuuuuauu

SEQ ID NO: 1317 - RNA, 21 nt, Artificial Sequence
  source: /note="Description of Artificial Sequence: Synthetic oligonucleotide"
uggagacaggggcuuuuauuu

SEQ ID NO: 1318 - RNA, 21 nt, Artificial Sequence
  source: /note="Description of Artificial Sequence: Synthetic oligonucleotide"
gagacaggggcuuuuauuuca

SEQ ID NO: 1319 - RNA, 21 nt, Artificial Sequence
  source: /note="Description of Artificial Sequence: Synthetic oligonucleotide"
cauguccuccucgcaucucuu

SEQ ID NO: 1320 - RNA, 21 nt, Artificial Sequence
  source: /note="Description of Artificial Sequence: Synthetic oligonucleotide"
uuuuauuucaacaagcccaca

SEQ ID NO: 1321 - RNA, 21 nt, Artificial Sequence
  source: /note="Description of Artificial Sequence: Synthetic oligonucleotide"
uguggagacaggggcuuuuau

SEQ ID NO: 1322 - RNA, 21 nt, Artificial Sequence
  source: /note="Description of Artificial Sequence: Synthetic oligonucleotide"
uggaugagugcugcuuccgga

SEQ ID NO: 1323 - RNA, 21 nt, Artificial Sequence
  source: /note="Description of Artificial Sequence: Synthetic oligonucleotide"
ucguguguggagacaggggcu

SEQ ID NO: 1324 - RNA, 21 nt, Artificial Sequence
  source: /note="Description of Artificial Sequence: Synthetic oligonucleotide"
gauguauugcgcaccccucaa

SEQ ID NO: 1325 - RNA, 21 nt, Artificial Sequence
  source: /note="Description of Artificial Sequence: Synthetic oligonucleotide"
uucaguucguguguggagaca

SEQ ID NO: 1326 - RNA, 21 nt, Artificial Sequence
  source: /note="Description of Artificial Sequence: Synthetic oligonucleotide"
cuccucgcaucucuucuaccu

SEQ ID NO: 1327 - RNA, 21 nt, Artificial Sequence
  source: /note="Description of Artificial Sequence: Synthetic oligonucleotide"
agauguauugcgcaccccuca

SEQ ID NO: 1328 - RNA, 21 nt, Artificial Sequence
  source: /note="Description of Artificial Sequence: Synthetic oligonucleotide"
gccacaccgacaugcccaaga

SEQ ID NO: 1329 - RNA, 21 nt, Artificial Sequence
  source: /note="Description of Artificial Sequence: Synthetic oligonucleotide"
ggagauguauugcgcaccccu

SEQ ID NO: 1330 - RNA, 21 nt, Artificial Sequence
  source: /note="Description of Artificial Sequence: Synthetic oligonucleotide"
uucaacaagcccacaggguau

SEQ ID NO: 1331 - RNA, 21 nt, Artificial Sequence
  source: /note="Description of Artificial Sequence: Synthetic oligonucleotide"
ugcccagcgccacaccgacau

SEQ ID NO: 1332 - RNA, 21 nt, Artificial Sequence
  source: /note="Description of Artificial Sequence: Synthetic oligonucleotide"
gcaucguggaugagugcugcu

SEQ ID NO: 1333 - RNA, 21 nt, Artificial Sequence
  source: /note="Description of Artificial Sequence: Synthetic oligonucleotide"
ggagacaggggcuuuuauuua

SEQ ID NO: 1334 - RNA, 21 nt, Artificial Sequence
  source: /note="Description of Artificial Sequence: Synthetic oligonucleotide"
gggcuuuuauuucaacaagca

SEQ ID NO: 1335 - RNA, 21 nt, Artificial Sequence
  source: /note="Description of Artificial Sequence: Synthetic oligonucleotide"
ucguggaugagugcugcuuca

SEQ ID NO: 1336 - RNA, 21 nt, Artificial Sequence
  source: /note="Description of Artificial Sequence: Synthetic oligonucleotide"
uccucgcaucucuucuaccua

SEQ ID NO: 1337 - RNA, 21 nt, Artificial Sequence
  source: /note="Description of Artificial Sequence: Synthetic oligonucleotide"
ggggcuuuuauuucaacaaga

SEQ ID NO: 1338 - RNA, 21 nt, Artificial Sequence
  source: /note="Description of Artificial Sequence: Synthetic oligonucleotide"
uuuauuucaacaagcccacaa

SEQ ID NO: 1339 - RNA, 21 nt, Artificial Sequence
  source: /note="Description of Artificial Sequence: Synthetic oligonucleotide"
gcuggagauguauugcgcaca

SEQ ID NO: 1340 - RNA, 21 nt, Artificial Sequence
  source: /note="Description of Artificial Sequence: Synthetic oligonucleotide"
ggguauggcuccagcagucga

SEQ ID NO: 1341 - RNA, 21 nt, Artificial Sequence
  source: /note="Description of Artificial Sequence: Synthetic oligonucleotide"
cuggagauguauugcgcacca

SEQ ID NO: 1342 - RNA, 21 nt, Artificial Sequence
  source: /note="Description of Artificial Sequence: Synthetic oligonucleotide"
gaagaugcacaccauguccua

SEQ ID NO: 1343 - RNA, 21 nt, Artificial Sequence
  source: /note="Description of Artificial Sequence: Synthetic oligonucleotide"
gaugcucuucaguucgugugu

SEQ ID NO: 1344 - RNA, 21 nt, Artificial Sequence
  source: /note="Description of Artificial Sequence: Synthetic oligonucleotide"
uggaugcucuucaguucgugu

SEQ ID NO: 1345 - RNA, 21 nt, Artificial Sequence
  source: /note="Description of Artificial Sequence: Synthetic oligonucleotide"
gguggaugcucuucaguucgu

SEQ ID NO: 1346 - RNA, 21 nt, Artificial Sequence
  source: /note="Description of Artificial Sequence: Synthetic oligonucleotide"
ugagcugguggaugcucuuca

SEQ ID NO: 1347 - RNA, 21 nt, Artificial Sequence
  source: /note="Description of Artificial Sequence: Synthetic oligonucleotide"
gcugguggaugcucuucaguu

SEQ ID NO: 1348 - RNA, 21 nt, Artificial Sequence
  source: /note="Description of Artificial Sequence: Synthetic oligonucleotide"
ggaugcucuucaguucgugua

SEQ ID NO: 1349 - RNA, 21 nt, Artificial Sequence
  source: /note="Description of Artificial Sequence: Synthetic oligonucleotide"
cugguggaugcucuucaguua

SEQ ID NO: 1350 - RNA, 21 nt, Artificial Sequence
  source: /note="Description of Artificial Sequence: Synthetic oligonucleotide"
ggcugagcugguggaugcucu

SEQ ID NO: 1351 - RNA, 21 nt, Artificial Sequence
  source: /note="Description of Artificial Sequence: Synthetic oligonucleotide"
cugagcugguggaugcucuua

SEQ ID NO: 1352 - RNA, 21 nt, Artificial Sequence
  source: /note="Description of Artificial Sequence: Synthetic oligonucleotide"
cauuguggaugaguguugcuu

SEQ ID NO: 1353 - RNA, 21 nt, Artificial Sequence
  source: /note="Description of Artificial Sequence: Synthetic oligonucleotide"
agauacacaucaugucgucuu

SEQ ID NO: 1354 - RNA, 21 nt, Artificial Sequence
  source: /note="Description of Artificial Sequence: Synthetic oligonucleotide"
uggaugaguguugcuuccgga

SEQ ID NO: 1355 - RNA, 21 nt, Artificial Sequence
  source: /note="Description of Artificial Sequence: Synthetic oligonucleotide"
uguugcuuccggagcugugau

SEQ ID NO: 1356 - RNA, 21 nt, Artificial Sequence
  source: /note="Description of Artificial Sequence: Synthetic oligonucleotide"
gcuuuuacuucaacaagccca

SEQ ID NO: 1357 - RNA, 21 nt, Artificial Sequence
  source: /note="Description of Artificial Sequence: Synthetic oligonucleotide"
augaguguugcuuccggagcu

SEQ ID NO: 1358 - RNA, 21 nt, Artificial Sequence
  source: /note="Description of Artificial Sequence: Synthetic oligonucleotide"
cacacugacaugcccaagacu

SEQ ID NO: 1359 - RNA, 21 nt, Artificial Sequence
  source: /note="Description of Artificial Sequence: Synthetic oligonucleotide"
gcuauggcuccagcauucgga

SEQ ID NO: 1360 - RNA, 21 nt, Artificial Sequence
  source: /note="Description of Artificial Sequence: Synthetic oligonucleotide"
aagauacacaucaugucgucu

SEQ ID NO: 1361 - RNA, 21 nt, Artificial Sequence
  source: /note="Description of Artificial Sequence: Synthetic oligonucleotide"
uugcuuccggagcugugaucu

SEQ ID NO: 1362 - RNA, 21 nt, Artificial Sequence
  source: /note="Description of Artificial Sequence: Synthetic oligonucleotide"
uccggagcugugaucugagga

SEQ ID NO: 1363 - RNA, 21 nt, Artificial Sequence
  source: /note="Description of Artificial Sequence: Synthetic oligonucleotide"
guggaugaguguugcuuccga

SEQ ID NO: 1364 - RNA, 21 nt, Artificial Sequence
  source: /note="Description of Artificial Sequence: Synthetic oligonucleotide"
uacacaucaugucgucuucaa

SEQ ID NO: 1365 - RNA, 21 nt, Artificial Sequence
  source: /note="Description of Artificial Sequence: Synthetic oligonucleotide"
aaagauacacaucaugucgua

SEQ ID NO: 1366 - RNA, 21 nt, Artificial Sequence
  source: /note="Description of Artificial Sequence: Synthetic oligonucleotide"
ggcuauggcuccagcauucga

SEQ ID NO: 1367 - RNA, 21 nt, Artificial Sequence
  source: /note="Description of Artificial Sequence: Synthetic oligonucleotide"
acacugacaugcccaagacua

SEQ ID NO: 1368 - RNA, 21 nt, Artificial Sequence
  source: /note="Description of Artificial Sequence: Synthetic oligonucleotide"
aguguugcuuccggagcugua

SEQ ID NO: 1369 - RNA, 21 nt, Artificial Sequence
  source: /note="Description of Artificial Sequence: Synthetic oligonucleotide"
gagacccuuugcggggcugaa

SEQ ID NO: 1370 - RNA, 21 nt, Artificial Sequence
  source: /note="Description of Artificial Sequence: Synthetic oligonucleotide"
acugacaugcccaagacucaa

SEQ ID NO: 1371 - RNA, 21 nt, Artificial Sequence
  source: /note="Description of Artificial Sequence: Synthetic oligonucleotide"
gauacacaucaugucgucuua

SEQ ID NO: 1372 - RNA, 21 nt, Artificial Sequence
  source: /note="Description of Artificial Sequence: Synthetic oligonucleotide"
aagcccacaggcuauggcuca

SEQ ID NO: 1373 - RNA, 23 nt, Artificial Sequence
  source: /note="Description of Artificial Sequence: Synthetic oligonucleotide"
uaucacagcuccggaagcagcac

SEQ ID NO: 1374 - RNA, 23 nt, Artificial Sequence
  source: /note="Description of Artificial Sequence: Synthetic oligonucleotide"
ucaccagcucagccccgcagagc

SEQ ID NO: 1375 - RNA, 23 nt, Artificial Sequence
  source: /note="Description of Artificial Sequence: Synthetic oligonucleotide"
uagcuggugaaggugagcaggca

SEQ ID NO: 1376 - RNA, 23 nt, Artificial Sequence
  source: /note="Description of Artificial Sequence: Synthetic oligonucleotide"
aauaaaagccccugucuccacac

SEQ ID NO: 1377 - RNA, 23 nt, Artificial Sequence
  source: /note="Description of Artificial Sequence: Synthetic oligonucleotide"
aaauaaaagccccugucuccaca

SEQ ID NO: 1378 - RNA, 23 nt, Artificial Sequence
  source: /note="Description of Artificial Sequence: Synthetic oligonucleotide"
ugaaauaaaagccccugucucca

SEQ ID NO: 1379 - RNA, 23 nt, Artificial Sequence
  source: /note="Description of Artificial Sequence: Synthetic oligonucleotide"
aagagaugcgaggaggacauggu

SEQ ID NO: 1380 - RNA, 23 nt, Artificial Sequence
  source: /note="Description of Artificial Sequence: Synthetic oligonucleotide"
ugugggcuuguugaaauaaaagc

SEQ ID NO: 1381 - RNA, 23 nt, Artificial Sequence
  source: /note="Description of Artificial Sequence: Synthetic oligonucleotide"
auaaaagccccugucuccacaca

SEQ ID NO: 1382 - RNA, 23 nt, Artificial Sequence
  source: /note="Description of Artificial Sequence: Synthetic oligonucleotide"
uccggaagcagcacucauccacg

SEQ ID NO: 1383 - RNA, 23 nt, Artificial Sequence
  source: /note="Description of Artificial Sequence: Synthetic oligonucleotide"
agccccugucuccacacacgaac

SEQ ID NO: 1384 - RNA, 23 nt, Artificial Sequence
  source: /note="Description of Artificial Sequence: Synthetic oligonucleotide"
uugaggggugcgcaauacaucuc

SEQ ID NO: 1385 - RNA, 23 nt, Artificial Sequence
  source: /note="Description of Artificial Sequence: Synthetic oligonucleotide"
ugucuccacacacgaacugaaga

SEQ ID NO: 1386 - RNA, 23 nt, Artificial Sequence
  source: /note="Description of Artificial Sequence: Synthetic oligonucleotide"
agguagaagagaugcgaggagga

SEQ ID NO: 1387 - RNA, 23 nt, Artificial Sequence
  source: /note="Description of Artificial Sequence: Synthetic oligonucleotide"
ugaggggugcgcaauacaucucc

SEQ ID NO: 1388 - RNA, 23 nt, Artificial Sequence
  source: /note="Description of Artificial Sequence: Synthetic oligonucleotide"
ucuugggcaugucgguguggcgc

SEQ ID NO: 1389 - RNA, 23 nt, Artificial Sequence
  source: /note="Description of Artificial Sequence: Synthetic oligonucleotide"
aggggugcgcaauacaucuccag

SEQ ID NO: 1390 - RNA, 23 nt, Artificial Sequence
  source: /note="Description of Artificial Sequence: Synthetic oligonucleotide"
auacccugugggcuuguugaaau

SEQ ID NO: 1391 - RNA, 23 nt, Artificial Sequence
  source: /note="Description of Artificial Sequence: Synthetic oligonucleotide"
augucgguguggcgcugggcacg

SEQ ID NO: 1392 - RNA, 23 nt, Artificial Sequence
  source: /note="Description of Artificial Sequence: Synthetic oligonucleotide"
agcagcacucauccacgaugccu

SEQ ID NO: 1393 - RNA, 23 nt, Artificial Sequence
  source: /note="Description of Artificial Sequence: Synthetic oligonucleotide"
uaaauaaaagccccugucuccac

SEQ ID NO: 1394 - RNA, 23 nt, Artificial Sequence
  source: /note="Description of Artificial Sequence: Synthetic oligonucleotide"
ugcuuguugaaauaaaagccccu

SEQ ID NO: 1395 - RNA, 23 nt, Artificial Sequence
  source: /note="Description of Artificial Sequence: Synthetic oligonucleotide"
ugaagcagcacucauccacgaug

SEQ ID NO: 1396 - RNA, 23 nt, Artificial Sequence
  source: /note="Description of Artificial Sequence: Synthetic oligonucleotide"
uagguagaagagaugcgaggagg

SEQ ID NO: 1397 - RNA, 23 nt, Artificial Sequence
  source: /note="Description of Artificial Sequence: Synthetic oligonucleotide"
ucuuguugaaauaaaagccccug

SEQ ID NO: 1398 - RNA, 23 nt, Artificial Sequence
  source: /note="Description of Artificial Sequence: Synthetic oligonucleotide"
uugugggcuuguugaaauaaaag

SEQ ID NO: 1399 - RNA, 23 nt, Artificial Sequence
  source: /note="Description of Artificial Sequence: Synthetic oligonucleotide"
ugugcgcaauacaucuccagccu

SEQ ID NO: 1400 - RNA, 23 nt, Artificial Sequence
  source: /note="Description of Artificial Sequence: Synthetic oligonucleotide"
ucgacugcuggagccauacccug

SEQ ID NO: 1401 - RNA, 23 nt, Artificial Sequence
  source: /note="Description of Artificial Sequence: Synthetic oligonucleotide"
uggugcgcaauacaucuccagcc

SEQ ID NO: 1402 - RNA, 23 nt, Artificial Sequence
  source: /note="Description of Artificial Sequence: Synthetic oligonucleotide"
uaggacauggugugcaucuucac

SEQ ID NO: 1403 - RNA, 23 nt, Artificial Sequence
  source: /note="Description of Artificial Sequence: Synthetic oligonucleotide"
acacacgaacugaagagcaucca

SEQ ID NO: 1404 - RNA, 23 nt, Artificial Sequence
  source: /note="Description of Artificial Sequence: Synthetic oligonucleotide"
acacgaacugaagagcauccacc

SEQ ID NO: 1405 - RNA, 23 nt, Artificial Sequence
  source: /note="Description of Artificial Sequence: Synthetic oligonucleotide"
acgaacugaagagcauccaccag

SEQ ID NO: 1406 - RNA, 23 nt, Artificial Sequence
  source: /note="Description of Artificial Sequence: Synthetic oligonucleotide"
ugaagagcauccaccagcucagc

SEQ ID NO: 1407 - RNA, 23 nt, Artificial Sequence
  source: /note="Description of Artificial Sequence: Synthetic oligonucleotide"
aacugaagagcauccaccagcuc

SEQ ID NO: 1408 - RNA, 23 nt, Artificial Sequence
  source: /note="Description of Artificial Sequence: Synthetic oligonucleotide"
uacacgaacugaagagcauccac

SEQ ID NO: 1409 - RNA, 23 nt, Artificial Sequence
  source: /note="Description of Artificial Sequence: Synthetic oligonucleotide"
uaacugaagagcauccaccagcu

SEQ ID NO: 1410 - RNA, 23 nt, Artificial Sequence
  source: /note="Description of Artificial Sequence: Synthetic oligonucleotide"
agagcauccaccagcucagcccc

SEQ ID NO: 1411 - RNA, 23 nt, Artificial Sequence
  source: /note="Description of Artificial Sequence: Synthetic oligonucleotide"
uaagagcauccaccagcucagcc

SEQ ID NO: 1412 - RNA, 23 nt, Artificial Sequence
  source: /note="Description of Artificial Sequence: Synthetic oligonucleotide"
aagcaacacucauccacaaugcc

SEQ ID NO: 1413 - RNA, 23 nt, Artificial Sequence
  source: /note="Description of Artificial Sequence: Synthetic oligonucleotide"
aagacgacaugauguguaucuuu

SEQ ID NO: 1414 - RNA, 23 nt, Artificial Sequence
  source: /note="Description of Artificial Sequence: Synthetic oligonucleotide"
uccggaagcaacacucauccaca

SEQ ID NO: 1415 - RNA, 23 nt, Artificial Sequence
  source: /note="Description of Artificial Sequence: Synthetic oligonucleotide"
aucacagcuccggaagcaacacu

SEQ ID NO: 1416 - RNA, 23 nt, Artificial Sequence
  source: /note="Description of Artificial Sequence: Synthetic oligonucleotide"
ugggcuuguugaaguaaaagccc

SEQ ID NO: 1417 - RNA, 23 nt, Artificial Sequence
  source: /note="Description of Artificial Sequence: Synthetic oligonucleotide"
agcuccggaagcaacacucaucc

SEQ ID NO: 1418 - RNA, 23 nt, Artificial Sequence
  source: /note="Description of Artificial Sequence: Synthetic oligonucleotide"
agucuugggcaugucaguguggc

SEQ ID NO: 1419 - RNA, 23 nt, Artificial Sequence
  source: /note="Description of Artificial Sequence: Synthetic oligonucleotide"
uccgaaugcuggagccauagccu

SEQ ID NO: 1420 - RNA, 23 nt, Artificial Sequence
  source: /note="Description of Artificial Sequence: Synthetic oligonucleotide"
agacgacaugauguguaucuuua

SEQ ID NO: 1421 - RNA, 23 nt, Artificial Sequence
  source: /note="Description of Artificial Sequence: Synthetic oligonucleotide"
agaucacagcuccggaagcaaca

SEQ ID NO: 1422 - RNA, 23 nt, Artificial Sequence
  source: /note="Description of Artificial Sequence: Synthetic oligonucleotide"
uccucagaucacagcuccggaag

SEQ ID NO: 1423 - RNA, 23 nt, Artificial Sequence
  source: /note="Description of Artificial Sequence: Synthetic oligonucleotide"
ucggaagcaacacucauccacaa

SEQ ID NO: 1424 - RNA, 23 nt, Artificial Sequence
  source: /note="Description of Artificial Sequence: Synthetic oligonucleotide"
uugaagacgacaugauguguauc

SEQ ID NO: 1425 - RNA, 23 nt, Artificial Sequence
  source: /note="Description of Artificial Sequence: Synthetic oligonucleotide"
uacgacaugauguguaucuuuau

SEQ ID NO: 1426 - RNA, 23 nt, Artificial Sequence
  source: /note="Description of Artificial Sequence: Synthetic oligonucleotide"
ucgaaugcuggagccauagccug

SEQ ID NO: 1427 - RNA, 23 nt, Artificial Sequence
  source: /note="Description of Artificial Sequence: Synthetic oligonucleotide"
uagucuugggcaugucagugugg

SEQ ID NO: 1428 - RNA, 23 nt, Artificial Sequence
  source: /note="Description of Artificial Sequence: Synthetic oligonucleotide"
uacagcuccggaagcaacacuca

SEQ ID NO: 1429 - RNA, 23 nt, Artificial Sequence
  source: /note="Description of Artificial Sequence: Synthetic oligonucleotide"
uucagccccgcaaagggucucug

SEQ ID NO: 1430 - RNA, 23 nt, Artificial Sequence
  source: /note="Description of Artificial Sequence: Synthetic oligonucleotide"
uugagucuugggcaugucagugu

SEQ ID NO: 1431 - RNA, 23 nt, Artificial Sequence
  source: /note="Description of Artificial Sequence: Synthetic oligonucleotide"
uaagacgacaugauguguaucuu

SEQ ID NO: 1432 - RNA, 23 nt, Artificial Sequence
  source: /note="Description of Artificial Sequence: Synthetic oligonucleotide"
ugagccauagccugugggcuugu

SEQ ID NO: 1433 - RNA, 21 nt, Artificial Sequence
  source: /note="Description of Artificial Sequence: Synthetic oligonucleotide"
gauacacaucaugucgucuua

SEQ ID NO: 1434 - RNA, 23 nt, Artificial Sequence
  source: /note="Description of Artificial Sequence: Synthetic oligonucleotide"
uaagacgacaugauguguaucuu

SEQ ID NO: 1435 - RNA, 21 nt, Artificial Sequence
  source: /note="Description of Artificial Sequence: Synthetic oligonucleotide"
acagaugagcucagcgucuuu

SEQ ID NO: 1436 - RNA, 23 nt, Artificial Sequence
  source: /note="Description of Artificial Sequence: Synthetic oligonucleotide"
aaagacgcugagcucaucugugu

SEQ ID NO: 1437 - RNA, 21 nt, Artificial Sequence
  source: /note="Description of Artificial Sequence: Synthetic oligonucleotide"
caauuaaaggcaaaggcaaua

SEQ ID NO: 1438 - RNA, 21 nt, Artificial Sequence
  source: /note="Description of Artificial Sequence: Synthetic oligonucleotide"
acaccuacaacaacaucacca

SEQ ID NO: 1439 - RNA, 21 nt, Artificial Sequence
  source: /note="Description of Artificial Sequence: Synthetic oligonucleotide"
uacaccuacaacaacaucaca

SEQ ID NO: 1440 - RNA, 21 nt, Artificial Sequence
  source: /note="Description of Artificial Sequence: Synthetic oligonucleotide"
caucaaggcaaacguguucga

SEQ ID NO: 1441 - RNA, 21 nt, Artificial Sequence
  source: /note="Description of Artificial Sequence: Synthetic oligonucleotide"
caccuacaacaacaucaccua

SEQ ID NO: 1442 - RNA, 21 nt, Artificial Sequence
  source: /note="Description of Artificial Sequence: Synthetic oligonucleotide"
cguacaccuacaacaacauca

SEQ ID NO: 1443 - RNA, 21 nt, Artificial Sequence
  source: /note="Description of Artificial Sequence: Synthetic oligonucleotide"
guacaccuacaacaacaucaa

SEQ ID NO: 1444 - RNA, 21 nt, Artificial Sequence
  source: /note="Description of Artificial Sequence: Synthetic oligonucleotide"
gacucuuccucaaggacaaca

SEQ ID NO: 1445 - RNA, 21 nt, Artificial Sequence
  source: /note="Description of Artificial Sequence: Synthetic oligonucleotide"
agccuuccagaaccucuccaa

SEQ ID NO: 1446 - RNA, 21 nt, Artificial Sequence
  source: /note="Description of Artificial Sequence: Synthetic oligonucleotide"
ucacgcuagaccacaaccaga

SEQ ID NO: 1447 - RNA, 21 nt, Artificial Sequence
  source: /note="Description of Artificial Sequence: Synthetic oligonucleotide"
uggacgucucgcacaaccgca

SEQ ID NO: 1448 - RNA, 21 nt, Artificial Sequence
  source: /note="Description of Artificial Sequence: Synthetic oligonucleotide"
accuggaccgcaaccucauca

SEQ ID NO: 1449 - RNA, 21 nt, Artificial Sequence
  source: /note="Description of Artificial Sequence: Synthetic oligonucleotide"
uggaccugucccacaaccgca

SEQ ID NO: 1450 - RNA, 21 nt, Artificial Sequence
  source: /note="Description of Artificial Sequence: Synthetic oligonucleotide"
ugcggcugucccacaacgcca

SEQ ID NO: 1451 - RNA, 21 nt, Artificial Sequence
  source: /note="Description of Artificial Sequence: Synthetic oligonucleotide"
cgcucggccucagcaacaaca

SEQ ID NO: 1452 - RNA, 21 nt, Artificial Sequence
  source: /note="Description of Artificial Sequence: Synthetic oligonucleotide"
ccucaggaacaacucacugca

SEQ ID NO: 1453 - RNA, 21 nt, Artificial Sequence
  source: /note="Description of Artificial Sequence: Synthetic oligonucleotide"
cugcggaccuucacgccgcaa

SEQ ID NO: 1454 - RNA, 21 nt, Artificial Sequence
  source: /note="Description of Artificial Sequence: Synthetic oligonucleotide"
ccucucugggaacugucucca

SEQ ID NO: 1455 - RNA, 21 nt, Artificial Sequence
  source: /note="Description of Artificial Sequence: Synthetic oligonucleotide"
gcucucccgcaaccgccugga

SEQ ID NO: 1456 - RNA, 21 nt, Artificial Sequence
  source: /note="Description of Artificial Sequence: Synthetic oligonucleotide"
cgucucgcacaaccgccugga

SEQ ID NO: 1457 - RNA, 21 nt, Artificial Sequence
  source: /note="Description of Artificial Sequence: Synthetic oligonucleotide"
cacgcuagaccacaaccagca

SEQ ID NO: 1458 - RNA, 21 nt, Artificial Sequence
  source: /note="Description of Artificial Sequence: Synthetic oligonucleotide"
ugcucucccgcaaccgccuga

SEQ ID NO: 1459 - RNA, 21 nt, Artificial Sequence
  source: /note="Description of Artificial Sequence: Synthetic oligonucleotide"
accucagccucaggaacaaca

SEQ ID NO: 1460 - RNA, 21 nt, Artificial Sequence
  source: /note="Description of Artificial Sequence: Synthetic oligonucleotide"
caccuucaaggaccugcacua

SEQ ID NO: 1461 - RNA, 21 nt, Artificial Sequence
  source: /note="Description of Artificial Sequence: Synthetic oligonucleotide"
ggccucgugggcauugaggaa

SEQ ID NO: 1462 - RNA, 21 nt, Artificial Sequence
  source: /note="Description of Artificial Sequence: Synthetic oligonucleotide"
accuucaaggaccugcacuua

SEQ ID NO: 1463 - RNA, 21 nt, Artificial Sequence
  source: /note="Description of Artificial Sequence: Synthetic oligonucleotide"
ggccuucuggcuggacgucua

SEQ ID NO: 1464 - RNA, 21 nt, Artificial Sequence
  source: /note="Description of Artificial Sequence: Synthetic oligonucleotide"
ggcauugaggagcagagccua

SEQ ID NO: 1465 - RNA, 21 nt, Artificial Sequence
  source: /note="Description of Artificial Sequence: Synthetic oligonucleotide"
gccuuccagaaccucuccaga

SEQ ID NO: 1466 - RNA, 21 nt, Artificial Sequence
  source: /note="Description of Artificial Sequence: Synthetic oligonucleotide"
gcggucaugaaccucucugga

SEQ ID NO: 1467 - RNA, 21 nt, Artificial Sequence
  source: /note="Description of Artificial Sequence: Synthetic oligonucleotide"
aggcuggaggacgggcucuua

SEQ ID NO: 1468 - RNA, 21 nt, Artificial Sequence
  source: /note="Description of Artificial Sequence: Synthetic oligonucleotide"
cucuaccuggaccgcaaccua

SEQ ID NO: 1469 - RNA, 21 nt, Artificial Sequence
  source: /note="Description of Artificial Sequence: Synthetic oligonucleotide"
gcggaugagcucagcgucuua

SEQ ID NO: 1470 - RNA, 21 nt, Artificial Sequence
  source: /note="Description of Artificial Sequence: Synthetic oligonucleotide"
ccgucugagcaggcuggagga

SEQ ID NO: 1471 - RNA, 21 nt, Artificial Sequence
  source: /note="Description of Artificial Sequence: Synthetic oligonucleotide"
ggucaugaaccucucugggaa

SEQ ID NO: 1472 - RNA, 21 nt, Artificial Sequence
  source: /note="Description of Artificial Sequence: Synthetic oligonucleotide"
cugcagcugggccacaaccga

SEQ ID NO: 1473 - RNA, 21 nt, Artificial Sequence
  source: /note="Description of Artificial Sequence: Synthetic oligonucleotide"
cgggagcuggaccugagcaga

SEQ ID NO: 1474 - RNA, 21 nt, Artificial Sequence
  source: /note="Description of Artificial Sequence: Synthetic oligonucleotide"
ccgccugugucugcagcuaca

SEQ ID NO: 1475 - RNA, 21 nt, Artificial Sequence
  source: /note="Description of Artificial Sequence: Synthetic oligonucleotide"
ucuucugcagcuccaggaaca

SEQ ID NO: 1476 - RNA, 21 nt, Artificial Sequence
  source: /note="Description of Artificial Sequence: Synthetic oligonucleotide"
cuggcugagcgcagcuuugaa

SEQ ID NO: 1477 - RNA, 21 nt, Artificial Sequence
  source: /note="Description of Artificial Sequence: Synthetic oligonucleotide"
cucgaccugaccuccaaccaa

SEQ ID NO: 1478 - RNA, 21 nt, Artificial Sequence
  source: /note="Description of Artificial Sequence: Synthetic oligonucleotide"
cucaaccucggcuggaauaga

SEQ ID NO: 1479 - RNA, 21 nt, Artificial Sequence
  source: /note="Description of Artificial Sequence: Synthetic oligonucleotide"
gccuagagaaccugugccaca

SEQ ID NO: 1480 - RNA, 21 nt, Artificial Sequence
  source: /note="Description of Artificial Sequence: Synthetic oligonucleotide"
cagcuugaggugcucacgcua

SEQ ID NO: 1481 - RNA, 21 nt, Artificial Sequence
  source: /note="Description of Artificial Sequence: Synthetic oligonucleotide"
cagguccucaguguccucaga

SEQ ID NO: 1482 - RNA, 21 nt, Artificial Sequence
  source: /note="Description of Artificial Sequence: Synthetic oligonucleotide"
gcugcgauggcuggaccugua

SEQ ID NO: 1483 - RNA, 21 nt, Artificial Sequence
  source: /note="Description of Artificial Sequence: Synthetic oligonucleotide"
ggcaagcuggaguaccugcua

SEQ ID NO: 1484 - RNA, 23 nt, Artificial Sequence
  source: /note="Description of Artificial Sequence: Synthetic oligonucleotide"
uauugccuuugccuuuaauugau

SEQ ID NO: 1485 - RNA, 23 nt, Artificial Sequence
  source: /note="Description of Artificial Sequence: Synthetic oligonucleotide"
uggugauguuguuguagguguac

SEQ ID NO: 1486 - RNA, 23 nt, Artificial Sequence
  source: /note="Description of Artificial Sequence: Synthetic oligonucleotide"
ugugauguuguuguagguguacg

SEQ ID NO: 1487 - RNA, 23 nt, Artificial Sequence
  source: /note="Description of Artificial Sequence: Synthetic oligonucleotide"
ucgaacacguuugccuugauggc

SEQ ID NO: 1488 - RNA, 23 nt, Artificial Sequence
  source: /note="Description of Artificial Sequence: Synthetic oligonucleotide"
uaggugauguuguuguaggugua

SEQ ID NO: 1489 - RNA, 23 nt, Artificial Sequence
  source: /note="Description of Artificial Sequence: Synthetic oligonucleotide"
ugauguuguuguagguguacgcg

SEQ ID NO: 1490 - RNA, 23 nt, Artificial Sequence
  source: /note="Description of Artificial Sequence: Synthetic oligonucleotide"
uugauguuguuguagguguacgc

SEQ ID NO: 1491 - RNA, 23 nt, Artificial Sequence
  source: /note="Description of Artificial Sequence: Synthetic oligonucleotide"
uguuguccuugaggaagagucgg

SEQ ID NO: 1492 - RNA, 23 nt, Artificial Sequence
  source: /note="Description of Artificial Sequence: Synthetic oligonucleotide"
uuggagagguucuggaaggcugc

SEQ ID NO: 1493 - RNA, 23 nt, Artificial Sequence
  source: /note="Description of Artificial Sequence: Synthetic oligonucleotide"
ucugguuguggucuagcgugagc

SEQ ID NO: 1494 - RNA, 23 nt, Artificial Sequence
  source: /note="Description of Artificial Sequence: Synthetic oligonucleotide"
ugcgguugugcgagacguccagc

SEQ ID NO: 1495 - RNA, 23 nt, Artificial Sequence
  source: /note="Description of Artificial Sequence: Synthetic oligonucleotide"
ugaugagguugcgguccagguag

SEQ ID NO: 1496 - RNA, 23 nt, Artificial Sequence
  source: /note="Description of Artificial Sequence: Synthetic oligonucleotide"
ugcgguugugggacagguccagc

SEQ ID NO: 1497 - RNA, 23 nt, Artificial Sequence
  source: /note="Description of Artificial Sequence: Synthetic oligonucleotide"
uggcguugugggacagccgcagc

SEQ ID NO: 1498 - RNA, 23 nt, Artificial Sequence
  source: /note="Description of Artificial Sequence: Synthetic oligonucleotide"
uguuguugcugaggccgagcgag

SEQ ID NO: 1499 - RNA, 23 nt, Artificial Sequence
  source: /note="Description of Artificial Sequence: Synthetic oligonucleotide"
ugcagugaguuguuccugaggcu

SEQ ID NO: 1500 - RNA, 23 nt, Artificial Sequence
  source: /note="Description of Artificial Sequence: Synthetic oligonucleotide"
uugcggcgugaagguccgcagug

SEQ ID NO: 1501 - RNA, 23 nt, Artificial Sequence
  source: /note="Description of Artificial Sequence: Synthetic oligonucleotide"
uggagacaguucccagagagguu

SEQ ID NO: 1502 - RNA, 23 nt, Artificial Sequence
  source: /note="Description of Artificial Sequence: Synthetic oligonucleotide"
uccaggcgguugcgggagagcag

SEQ ID NO: 1503 - RNA, 23 nt, Artificial Sequence
  source: /note="Description of Artificial Sequence: Synthetic oligonucleotide"
uccaggcgguugugcgagacguc

SEQ ID NO: 1504 - RNA, 23 nt, Artificial Sequence
  source: /note="Description of Artificial Sequence: Synthetic oligonucleotide"
ugcugguuguggucuagcgugag

SEQ ID NO: 1505 - RNA, 23 nt, Artificial Sequence
  source: /note="Description of Artificial Sequence: Synthetic oligonucleotide"
ucaggcgguugcgggagagcagc

SEQ ID NO: 1506 - RNA, 23 nt, Artificial Sequence
  source: /note="Description of Artificial Sequence: Synthetic oligonucleotide"
uguuguuccugaggcugagguag

SEQ ID NO: 1507 - RNA, 23 nt, Artificial Sequence
  source: /note="Description of Artificial Sequence: Synthetic oligonucleotide"
uagugcagguccuugaaggugcg

SEQ ID NO: 1508 - RNA, 23 nt, Artificial Sequence
  source: /note="Description of Artificial Sequence: Synthetic oligonucleotide"
uuccucaaugcccacgaggccgu

SEQ ID NO: 1509 - RNA, 23 nt, Artificial Sequence
  source: /note="Description of Artificial Sequence: Synthetic oligonucleotide"
uaagugcagguccuugaaggugc

SEQ ID NO: 1510 - RNA, 23 nt, Artificial Sequence
  source: /note="Description of Artificial Sequence: Synthetic oligonucleotide"
uagacguccagccagaaggcccg

SEQ ID NO: 1511 - RNA, 23 nt, Artificial Sequence
  source: /note="Description of Artificial Sequence: Synthetic oligonucleotide"
uaggcucugcuccucaaugccca

SEQ ID NO: 1512 - RNA, 23 nt, Artificial Sequence
  source: /note="Description of Artificial Sequence: Synthetic oligonucleotide"
ucuggagagguucuggaaggcug

SEQ ID NO: 1513 - RNA, 23 nt, Artificial Sequence
  source: /note="Description of Artificial Sequence: Synthetic oligonucleotide"
uccagagagguucaugaccgcca

SEQ ID NO: 1514 - RNA, 23 nt, Artificial Sequence
  source: /note="Description of Artificial Sequence: Synthetic oligonucleotide"
uaagagcccguccuccagccugc

SEQ ID NO: 1515 - RNA, 23 nt, Artificial Sequence
  source: /note="Description of Artificial Sequence: Synthetic oligonucleotide"
uagguugcgguccagguagaguu

SEQ ID NO: 1516 - RNA, 23 nt, Artificial Sequence
  source: /note="Description of Artificial Sequence: Synthetic oligonucleotide"
uaagacgcugagcucauccgcgu

SEQ ID NO: 1517 - RNA, 23 nt, Artificial Sequence
  source: /note="Description of Artificial Sequence: Synthetic oligonucleotide"
uccuccagccugcucagacgguu

SEQ ID NO: 1518 - RNA, 23 nt, Artificial Sequence
  source: /note="Description of Artificial Sequence: Synthetic oligonucleotide"
uucccagagagguucaugaccgc

SEQ ID NO: 1519 - RNA, 23 nt, Artificial Sequence
  source: /note="Description of Artificial Sequence: Synthetic oligonucleotide"
ucgguuguggcccagcugcagcu

SEQ ID NO: 1520 - RNA, 23 nt, Artificial Sequence
  source: /note="Description of Artificial Sequence: Synthetic oligonucleotide"
ucugcucagguccagcucccgga

SEQ ID NO: 1521 - RNA, 23 nt, Artificial Sequence
  source: /note="Description of Artificial Sequence: Synthetic oligonucleotide"
uguagcugcagacacaggcggcc

SEQ ID NO: 1522 - RNA, 23 nt, Artificial Sequence
  source: /note="Description of Artificial Sequence: Synthetic oligonucleotide"
uguuccuggagcugcagaagacg

SEQ ID NO: 1523 - RNA, 23 nt, Artificial Sequence
  source: /note="Description of Artificial Sequence: Synthetic oligonucleotide"
uucaaagcugcgcucagccagcu

SEQ ID NO: 1524 - RNA, 23 nt, Artificial Sequence
  source: /note="Description of Artificial Sequence: Synthetic oligonucleotide"
uugguuggaggucaggucgagcu

SEQ ID NO: 1525 - RNA, 23 nt, Artificial Sequence
  source: /note="Description of Artificial Sequence: Synthetic oligonucleotide"
ucuauuccagccgagguugaggu

SEQ ID NO: 1526 - RNA, 23 nt, Artificial Sequence
  source: /note="Description of Artificial Sequence: Synthetic oligonucleotide"
uguggcacagguucucuaggccc

SEQ ID NO: 1527 - RNA, 23 nt, Artificial Sequence
  source: /note="Description of Artificial Sequence: Synthetic oligonucleotide"
uagcgugagcaccucaagcugcc

SEQ ID NO: 1528 - RNA, 23 nt, Artificial Sequence
  source: /note="Description of Artificial Sequence: Synthetic oligonucleotide"
ucugaggacacugaggaccuguc

SEQ ID NO: 1529 - RNA, 23 nt, Artificial Sequence
  source: /note="Description of Artificial Sequence: Synthetic oligonucleotide"
uacagguccagccaucgcagcgc

SEQ ID NO: 1530 - RNA, 23 nt, Artificial Sequence
  source: /note="Description of Artificial Sequence: Synthetic oligonucleotide"
uagcagguacuccagcuugccca

SEQ ID NO: 1531 - RNA, 21 nt, Artificial Sequence
  source: /note="Description of Artificial Sequence: Synthetic oligonucleotide"
caauuaaaggcaaaggcaaua

SEQ ID NO: 1532 - RNA, 21 nt, Artificial Sequence
  source: /note="Description of Artificial Sequence: Synthetic oligonucleotide"
acaccuacaacaacaucacca

SEQ ID NO: 1533 - RNA, 21 nt, Artificial Sequence
  source: /note="Description of Artificial Sequence: Synthetic oligonucleotide"
uacaccuacaacaacaucaca

SEQ ID NO: 1534 - RNA, 21 nt, Artificial Sequence
  source: /note="Description of Artificial Sequence: Synthetic oligonucleotide"
caucaaggcaaacguguucga

SEQ ID NO: 1535 - RNA, 21 nt, Artificial Sequence
  source: /note="Description of Artificial Sequence: Synthetic oligonucleotide"
caccuacaacaacaucaccua

SEQ ID NO: 1536 - RNA, 21 nt, Artificial Sequence
  source: /note="Description of Artificial Sequence: Synthetic oligonucleotide"
cguacaccuacaacaacauca

SEQ ID NO: 1537 - RNA, 21 nt, Artificial Sequence
  source: /note="Description of Artificial Sequence: Synthetic oligonucleotide"
guacaccuacaacaacaucaa

SEQ ID NO: 1538 - RNA, 21 nt, Artificial Sequence
  source: /note="Description of Artificial Sequence: Synthetic oligonucleotide"
gacucuuccucaaggacaaca

SEQ ID NO: 1539 - RNA, 21 nt, Artificial Sequence
  source: /note="Description of Artificial Sequence: Synthetic oligonucleotide"
agccuuccagaaccucuccaa

SEQ ID NO: 1540 - RNA, 21 nt, Artificial Sequence
  source: /note="Description of Artificial Sequence: Synthetic oligonucleotide"
ucacgcuagaccacaaccaga

SEQ ID NO: 1541 - RNA, 21 nt, Artificial Sequence
  source: /note="Description of Artificial Sequence: Synthetic oligonucleotide"
uggacgucucgcacaaccgca

SEQ ID NO: 1542 - RNA, 21 nt, Artificial Sequence
  source: /note="Description of Artificial Sequence: Synthetic oligonucleotide"
accuggaccgcaaccucauca

SEQ ID NO: 1543 - RNA, 21 nt, Artificial Sequence
  source: /note="Description of Artificial Sequence: Synthetic oligonucleotide"
uggaccugucccacaaccgca

SEQ ID NO: 1544 - RNA, 21 nt, Artificial Sequence
  source: /note="Description of Artificial Sequence: Synthetic oligonucleotide"
ugcggcugucccacaacgcca

SEQ ID NO: 1545 - RNA, 21 nt, Artificial Sequence
  source: /note="Description of Artificial Sequence: Synthetic oligonucleotide"
cgcucggccucagcaacaaca

SEQ ID NO: 1546 - RNA, 21 nt, Artificial Sequence
  source: /note="Description of Artificial Sequence: Synthetic oligonucleotide"
ccucaggaacaacucacugca

SEQ ID NO: 1547 - RNA, 21 nt, Artificial Sequence
  source: /note="Description of Artificial Sequence: Synthetic oligonucleotide"
cugcggaccuucacgccgcaa

SEQ ID NO: 1548 - RNA, 21 nt, Artificial Sequence
  source: /note="Description of Artificial Sequence: Synthetic oligonucleotide"
ccucucugggaacugucucca

SEQ ID NO: 1549 - RNA, 21 nt, Artificial Sequence
  source: /note="Description of Artificial Sequence: Synthetic oligonucleotide"
gcucucccgcaaccgccugga

SEQ ID NO: 1550 - RNA, 21 nt, Artificial Sequence
  source: /note="Description of Artificial Sequence: Synthetic oligonucleotide"
cgucucgcacaaccgccugga

SEQ ID NO: 1551 - RNA, 21 nt, Artificial Sequence
  source: /note="Description of Artificial Sequence: Synthetic oligonucleotide"
cacgcuagaccacaaccagca

SEQ ID NO: 1552 - RNA, 21 nt, Artificial Sequence
  source: /note="Description of Artificial Sequence: Synthetic oligonucleotide"
ugcucucccgcaaccgccuga

SEQ ID NO: 1553 - RNA, 21 nt, Artificial Sequence
  source: /note="Description of Artificial Sequence: Synthetic oligonucleotide"
accucagccucaggaacaaca

SEQ ID NO: 1554 - RNA, 21 nt, Artificial Sequence
  source: /note="Description of Artificial Sequence: Synthetic oligonucleotide"
caccuucaaggaccugcacua

SEQ ID NO: 1555 - RNA, 21 nt, Artificial Sequence
  source: /note="Description of Artificial Sequence: Synthetic oligonucleotide"
ggccucgugggcauugaggaa

SEQ ID NO: 1556 - RNA, 21 nt, Artificial Sequence
  source: /note="Description of Artificial Sequence: Synthetic oligonucleotide"
accuucaaggaccugcacuua

SEQ ID NO: 1557 - RNA, 21 nt, Artificial Sequence
  source: /note="Description of Artificial Sequence: Synthetic oligonucleotide"
ggccuucuggcuggacgucua

SEQ ID NO: 1558 - RNA, 21 nt, Artificial Sequence
  source: /note="Description of Artificial Sequence: Synthetic oligonucleotide"
ggcauugaggagcagagccua

SEQ ID NO: 1559 - RNA, 21 nt, Artificial Sequence
  source: /note="Description of Artificial Sequence: Synthetic oligonucleotide"
gccuuccagaaccucuccaga

SEQ ID NO: 1560 - RNA, 21 nt, Artificial Sequence
  source: /note="Description of Artificial Sequence: Synthetic oligonucleotide"
gcggucaugaaccucucugga

SEQ ID NO: 1561 - RNA, 21 nt, Artificial Sequence
  source: /note="Description of Artificial Sequence: Synthetic oligonucleotide"
aggcuggaggacgggcucuua

SEQ ID NO: 1562 - RNA, 21 nt, Artificial Sequence
  source: /note="Description of Artificial Sequence: Synthetic oligonucleotide"
cucuaccuggaccgcaaccua

SEQ ID NO: 1563 - RNA, 21 nt, Artificial Sequence
  source: /note="Description of Artificial Sequence: Synthetic oligonucleotide"
gcggaugagcucagcgucuua

SEQ ID NO: 1564 - RNA, 21 nt, Artificial Sequence
  source: /note="Description of Artificial Sequence: Synthetic oligonucleotide"
ccgucugagcaggcuggagga

SEQ ID NO: 1565 - RNA, 21 nt, Artificial Sequence
  source: /note="Description of Artificial Sequence: Synthetic oligonucleotide"
ggucaugaaccucucugggaa

SEQ ID NO: 1566 - RNA, 21 nt, Artificial Sequence
  source: /note="Description of Artificial Sequence: Synthetic oligonucleotide"
cugcagcugggccacaaccga

SEQ ID NO: 1567 - RNA, 21 nt, Artificial Sequence
  source: /note="Description of Artificial Sequence: Synthetic oligonucleotide"
cgggagcuggaccugagcaga

SEQ ID NO: 1568 - RNA, 21 nt, Artificial Sequence
  source: /note="Description of Artificial Sequence: Synthetic oligonucleotide"
ccgccugugucugcagcuaca

SEQ ID NO: 1569 - RNA, 21 nt, Artificial Sequence
  source: /note="Description of Artificial Sequence: Synthetic oligonucleotide"
ucuucugcagcuccaggaaca

SEQ ID NO: 1570 - RNA, 21 nt, Artificial Sequence
  source: /note="Description of Artificial Sequence: Synthetic oligonucleotide"
cuggcugagcgcagcuuugaa

SEQ ID NO: 1571 - RNA, 21 nt, Artificial Sequence
  source: /note="Description of Artificial Sequence: Synthetic oligonucleotide"
cucgaccugaccuccaaccaa

SEQ ID NO: 1572 - RNA, 21 nt, Artificial Sequence
  source: /note="Description of Artificial Sequence: Synthetic oligonucleotide"
cucaaccucggcuggaauaga

SEQ ID NO: 1573 - RNA, 21 nt, Artificial Sequence
  source: /note="Description of Artificial Sequence: Synthetic oligonucleotide"
gccuagagaaccugugccaca

SEQ ID NO: 1574 - RNA, 21 nt, Artificial Sequence
  source: /note="Description of Artificial Sequence: Synthetic oligonucleotide"
cagcuugaggugcucacgcua

SEQ ID NO: 1575 - RNA, 21 nt, Artificial Sequence
  source: /note="Description of Artificial Sequence: Synthetic oligonucleotide"
cagguccucaguguccucaga

SEQ ID NO: 1576 - RNA, 21 nt, Artificial Sequence
  source: /note="Description of Artificial Sequence: Synthetic oligonucleotide"
gcugcgauggcuggaccugua

SEQ ID NO: 1577 - RNA, 21 nt, Artificial Sequence
  source: /note="Description of Artificial Sequence: Synthetic oligonucleotide"
ggcaagcuggaguaccugcua

SEQ ID NO: 1578 - RNA, 23 nt, Artificial Sequence
  source: /note="Description of Artificial Sequence: Synthetic oligonucleotide"
uauugccuuugccuuuaauugau

SEQ ID NO: 1579 - RNA, 23 nt, Artificial Sequence
  source: /note="Description of Artificial Sequence: Synthetic oligonucleotide"
uggugauguuguuguagguguac

SEQ ID NO: 1580 - RNA, 23 nt, Artificial Sequence
  source: /note="Description of Artificial Sequence: Synthetic oligonucleotide"
ugugauguuguuguagguguacg

SEQ ID NO: 1581 - RNA, 23 nt, Artificial Sequence
  source: /note="Description of Artificial Sequence: Synthetic oligonucleotide"
ucgaacacguuugccuugauggc

SEQ ID NO: 1582 - RNA, 23 nt, Artificial Sequence
  source: /note="Description of Artificial Sequence: Synthetic oligonucleotide"
uaggugauguuguuguaggugua

SEQ ID NO: 1583 - RNA, 23 nt, Artificial Sequence
  source: /note="Description of Artificial Sequence: Synthetic oligonucleotide"
ugauguuguuguagguguacgcg

SEQ ID NO: 1584 - RNA, 23 nt, Artificial Sequence
  source: /note="Description of Artificial Sequence: Synthetic oligonucleotide"
uugauguuguuguagguguacgc

SEQ ID NO: 1585 - RNA, 23 nt, Artificial Sequence
  source: /note="Description of Artificial Sequence: Synthetic oligonucleotide"
uguuguccuugaggaagagucgg

SEQ ID NO: 1586 - RNA, 23 nt, Artificial Sequence
  source: /note="Description of Artificial Sequence: Synthetic oligonucleotide"
uuggagagguucuggaaggcugc

SEQ ID NO: 1587 - RNA, 23 nt, Artificial Sequence
  source: /note="Description of Artificial Sequence: Synthetic oligonucleotide"
ucugguuguggucuagcgugagc

SEQ ID NO: 1588 - RNA, 23 nt, Artificial Sequence
  source: /note="Description of Artificial Sequence: Synthetic oligonucleotide"
ugcgguugugcgagacguccagc

SEQ ID NO: 1589 - RNA, 23 nt, Artificial Sequence
  source: /note="Description of Artificial Sequence: Synthetic oligonucleotide"
ugaugagguugcgguccagguag

SEQ ID NO: 1590 - RNA, 23 nt, Artificial Sequence
  source: /note="Description of Artificial Sequence: Synthetic oligonucleotide"
ugcgguugugggacagguccagc

SEQ ID NO: 1591 - RNA, 23 nt, Artificial Sequence
  source: /note="Description of Artificial Sequence: Synthetic oligonucleotide"
uggcguugugggacagccgcagc

SEQ ID NO: 1592 - RNA, 23 nt, Artificial Sequence
  source: /note="Description of Artificial Sequence: Synthetic oligonucleotide"
uguuguugcugaggccgagcgag

SEQ ID NO: 1593 - RNA, 23 nt, Artificial Sequence
  source: /note="Description of Artificial Sequence: Synthetic oligonucleotide"
ugcagugaguuguuccugaggcu

SEQ ID NO: 1594 - RNA, 23 nt, Artificial Sequence
  source: /note="Description of Artificial Sequence: Synthetic oligonucleotide"
uugcggcgugaagguccgcagug

SEQ ID NO: 1595 - RNA, 23 nt, Artificial Sequence
  source: /note="Description of Artificial Sequence: Synthetic oligonucleotide"
uggagacaguucccagagagguu

SEQ ID NO: 1596 - RNA, 23 nt, Artificial Sequence
  source: /note="Description of Artificial Sequence: Synthetic oligonucleotide"
uccaggcgguugcgggagagcag

SEQ ID NO: 1597 - RNA, 23 nt, Artificial Sequence
  source: /note="Description of Artificial Sequence: Synthetic oligonucleotide"
uccaggcgguugugcgagacguc

SEQ ID NO: 1598 - RNA, 23 nt, Artificial Sequence
  source: /note="Description of Artificial Sequence: Synthetic oligonucleotide"
ugcugguuguggucuagcgugag

SEQ ID NO: 1599 - RNA, 23 nt, Artificial Sequence
  source: /note="Description of Artificial Sequence: Synthetic oligonucleotide"
ucaggcgguugcgggagagcagc

SEQ ID NO: 1600 - RNA, 23 nt, Artificial Sequence
  source: /note="Description of Artificial Sequence: Synthetic oligonucleotide"
uguuguuccugaggcugagguag

SEQ ID NO: 1601 - RNA, 23 nt, Artificial Sequence
  source: /note="Description of Artificial Sequence: Synthetic oligonucleotide"
uagugcagguccuugaaggugcg

SEQ ID NO: 1602 - RNA, 23 nt, Artificial Sequence
  source: /note="Description of Artificial Sequence: Synthetic oligonucleotide"
uuccucaaugcccacgaggccgu

SEQ ID NO: 1603 - RNA, 23 nt, Artificial Sequence
  source: /note="Description of Artificial Sequence: Synthetic oligonucleotide"
uaagugcagguccuugaaggugc

SEQ ID NO: 1604 - RNA, 23 nt, Artificial Sequence
  source: /note="Description of Artificial Sequence: Synthetic oligonucleotide"
uagacguccagccagaaggcccg

SEQ ID NO: 1605 - RNA, 23 nt, Artificial Sequence
  source: /note="Description of Artificial Sequence: Synthetic oligonucleotide"
uaggcucugcuccucaaugccca

SEQ ID NO: 1606 - RNA, 23 nt, Artificial Sequence
  source: /note="Description of Artificial Sequence: Synthetic oligonucleotide"
ucuggagagguucuggaaggcug

SEQ ID NO: 1607 - RNA, 23 nt, Artificial Sequence
  source: /note="Description of Artificial Sequence: Synthetic oligonucleotide"
uccagagagguucaugaccgcca

SEQ ID NO: 1608 - RNA, 23 nt, Artificial Sequence
  source: /note="Description of Artificial Sequence: Synthetic oligonucleotide"
uaagagcccguccuccagccugc

SEQ ID NO: 1609 - RNA, 23 nt, Artificial Sequence
  source: /note="Description of Artificial Sequence: Synthetic oligonucleotide"
uagguugcgguccagguagaguu

SEQ ID NO: 1610 - RNA, 23 nt, Artificial Sequence
  source: /note="Description of Artificial Sequence: Synthetic oligonucleotide"
uaagacgcugagcucauccgcgu

SEQ ID NO: 1611 - RNA, 23 nt, Artificial Sequence
  source: /note="Description of Artificial Sequence: Synthetic oligonucleotide"
uccuccagccugcucagacgguu

SEQ ID NO: 1612 - RNA, 23 nt, Artificial Sequence
  source: /note="Description of Artificial Sequence: Synthetic oligonucleotide"
uucccagagagguucaugaccgc

SEQ ID NO: 1613 - RNA, 23 nt, Artificial Sequence
  source: /note="Description of Artificial Sequence: Synthetic oligonucleotide"
ucgguuguggcccagcugcagcu

SEQ ID NO: 1614 - RNA, 23 nt, Artificial Sequence
  source: /note="Description of Artificial Sequence: Synthetic oligonucleotide"
ucugcucagguccagcucccgga

SEQ ID NO: 1615 - RNA, 23 nt, Artificial Sequence
  source: /note="Description of Artificial Sequence: Synthetic oligonucleotide"
uguagcugcagacacaggcggcc

SEQ ID NO: 1616 - RNA, 23 nt, Artificial Sequence
  source: /note="Description of Artificial Sequence: Synthetic oligonucleotide"
uguuccuggagcugcagaagacg

SEQ ID NO: 1617 - RNA, 23 nt, Artificial Sequence
  source: /note="Description of Artificial Sequence: Synthetic oligonucleotide"
uucaaagcugcgcucagccagcu

SEQ ID NO: 1618 - RNA, 23 nt, Artificial Sequence
  source: /note="Description of Artificial Sequence: Synthetic oligonucleotide"
uugguuggaggucaggucgagcu

SEQ ID NO: 1619 - RNA, 23 nt, Artificial Sequence
  source: /note="Description of Artificial Sequence: Synthetic oligonucleotide"
ucuauuccagccgagguugaggu

SEQ ID NO: 1620 - RNA, 23 nt, Artificial Sequence
  source: /note="Description of Artificial Sequence: Synthetic oligonucleotide"
uguggcacagguucucuaggccc

SEQ ID NO: 1621 - RNA, 23 nt, Artificial Sequence
  source: /note="Description of Artificial Sequence: Synthetic oligonucleotide"
uagcgugagcaccucaagcugcc

SEQ ID NO: 1622 - RNA, 23 nt, Artificial Sequence
  source: /note="Description of Artificial Sequence: Synthetic oligonucleotide"
ucugaggacacugaggaccuguc

SEQ ID NO: 1623 - RNA, 23 nt, Artificial Sequence
  source: /note="Description of Artificial Sequence: Synthetic oligonucleotide"
uacagguccagccaucgcagcgc

SEQ ID NO: 1624 - RNA, 23 nt, Artificial Sequence
  source: /note="Description of Artificial Sequence: Synthetic oligonucleotide"
uagcagguacuccagcuugccca

SEQ ID NO: 1625 - RNA, 23 nt, Artificial Sequence
  source: /note="Description of Artificial Sequence: Synthetic oligonucleotide"
aucaauuaaaggcaaaggcaauc

SEQ ID NO: 1626 - RNA, 23 nt, Artificial Sequence
  source: /note="Description of Artificial Sequence: Synthetic oligonucleotide"
guacaccuacaacaacaucaccu

SEQ ID NO: 1627 - RNA, 23 nt, Artificial Sequence
  source: /note="Description of Artificial Sequence: Synthetic oligonucleotide"
cguacaccuacaacaacaucacc

SEQ ID NO: 1628 - RNA, 23 nt, Artificial Sequence
  source: /note="Description of Artificial Sequence: Synthetic oligonucleotide"
gccaucaaggcaaacguguucgu

SEQ ID NO: 1629 - RNA, 23 nt, Artificial Sequence
  source: /note="Description of Artificial Sequence: Synthetic oligonucleotide"
uacaccuacaacaacaucaccug

SEQ ID NO: 1630 - RNA, 23 nt, Artificial Sequence
  source: /note="Description of Artificial Sequence: Synthetic oligonucleotide"
cgcguacaccuacaacaacauca

SEQ ID NO: 1631 - RNA, 23 nt, Artificial Sequence
  source: /note="Description of Artificial Sequence: Synthetic oligonucleotide"
gcguacaccuacaacaacaucac

SEQ ID NO: 1632 - RNA, 23 nt, Artificial Sequence
  source: /note="Description of Artificial Sequence: Synthetic oligonucleotide"
ccgacucuuccucaaggacaacg

SEQ ID NO: 1633 - RNA, 23 nt, Artificial Sequence
  source: /note="Description of Artificial Sequence: Synthetic oligonucleotide"
gcagccuuccagaaccucuccag

SEQ ID NO: 1634 - RNA, 23 nt, Artificial Sequence
  source: /note="Description of Artificial Sequence: Synthetic oligonucleotide"
gcucacgcuagaccacaaccagc

SEQ ID NO: 1635 - RNA, 23 nt, Artificial Sequence
  source: /note="Description of Artificial Sequence: Synthetic oligonucleotide"
gcuggacgucucgcacaaccgcc

SEQ ID NO: 1636 - RNA, 23 nt, Artificial Sequence
  source: /note="Description of Artificial Sequence: Synthetic oligonucleotide"
cuaccuggaccgcaaccucaucg

SEQ ID NO: 1637 - RNA, 23 nt, Artificial Sequence
  source: /note="Description of Artificial Sequence: Synthetic oligonucleotide"
gcuggaccugucccacaaccgcg

SEQ ID NO: 1638 - RNA, 23 nt, Artificial Sequence
  source: /note="Description of Artificial Sequence: Synthetic oligonucleotide"
gcugcggcugucccacaacgcca

SEQ ID NO: 1639 - RNA, 23 nt, Artificial Sequence
  source: /note="Description of Artificial Sequence: Synthetic oligonucleotide"
cucgcucggccucagcaacaacc

SEQ ID NO: 1640 - RNA, 23 nt, Artificial Sequence
  source: /note="Description of Artificial Sequence: Synthetic oligonucleotide"
agccucaggaacaacucacugcg

SEQ ID NO: 1641 - RNA, 23 nt, Artificial Sequence
  source: /note="Description of Artificial Sequence: Synthetic oligonucleotide"
cacugcggaccuucacgccgcag

SEQ ID NO: 1642 - RNA, 23 nt, Artificial Sequence
  source: /note="Description of Artificial Sequence: Synthetic oligonucleotide"
aaccucucugggaacugucuccg

SEQ ID NO: 1643 - RNA, 23 nt, Artificial Sequence
  source: /note="Description of Artificial Sequence: Synthetic oligonucleotide"
cugcucucccgcaaccgccuggc

SEQ ID NO: 1644 - RNA, 23 nt, Artificial Sequence
  source: /note="Description of Artificial Sequence: Synthetic oligonucleotide"
gacgucucgcacaaccgccugga

SEQ ID NO: 1645 - RNA, 23 nt, Artificial Sequence
  source: /note="Description of Artificial Sequence: Synthetic oligonucleotide"
cucacgcuagaccacaaccagcu

SEQ ID NO: 1646 - RNA, 23 nt, Artificial Sequence
  source: /note="Description of Artificial Sequence: Synthetic oligonucleotide"
gcugcucucccgcaaccgccugg

SEQ ID NO: 1647 - RNA, 23 nt, Artificial Sequence
  source: /note="Description of Artificial Sequence: Synthetic oligonucleotide"
cuaccucagccucaggaacaacu

SEQ ID NO: 1648 - RNA, 23 nt, Artificial Sequence
  source: /note="Description of Artificial Sequence: Synthetic oligonucleotide"
cgcaccuucaaggaccugcacuu

SEQ ID NO: 1649 - RNA, 23 nt, Artificial Sequence
  source: /note="Description of Artificial Sequence: Synthetic oligonucleotide"
acggccucgugggcauugaggag

SEQ ID NO: 1650 - RNA, 23 nt, Artificial Sequence
  source: /note="Description of Artificial Sequence: Synthetic oligonucleotide"
gcaccuucaaggaccugcacuuc

SEQ ID NO: 1651 - RNA, 23 nt, Artificial Sequence
  source: /note="Description of Artificial Sequence: Synthetic oligonucleotide"
cgggccuucuggcuggacgucuc

SEQ ID NO: 1652 - RNA, 23 nt, Artificial Sequence
  source: /note="Description of Artificial Sequence: Synthetic oligonucleotide"
ugggcauugaggagcagagccug

SEQ ID NO: 1653 - RNA, 23 nt, Artificial Sequence
  source: /note="Description of Artificial Sequence: Synthetic oligonucleotide"
cagccuuccagaaccucuccagc

SEQ ID NO: 1654 - RNA, 23 nt, Artificial Sequence
  source: /note="Description of Artificial Sequence: Synthetic oligonucleotide"
uggcggucaugaaccucucuggg

SEQ ID NO: 1655 - RNA, 23 nt, Artificial Sequence
  source: /note="Description of Artificial Sequence: Synthetic oligonucleotide"
gcaggcuggaggacgggcucuuc

SEQ ID NO: 1656 - RNA, 23 nt, Artificial Sequence
  source: /note="Description of Artificial Sequence: Synthetic oligonucleotide"
aacucuaccuggaccgcaaccuc

SEQ ID NO: 1657 - RNA, 23 nt, Artificial Sequence
  source: /note="Description of Artificial Sequence: Synthetic oligonucleotide"
acgcggaugagcucagcgucuuc

SEQ ID NO: 1658 - RNA, 23 nt, Artificial Sequence
  source: /note="Description of Artificial Sequence: Synthetic oligonucleotide"
aaccgucugagcaggcuggagga

SEQ ID NO: 1659 - RNA, 23 nt, Artificial Sequence
  source: /note="Description of Artificial Sequence: Synthetic oligonucleotide"
gcggucaugaaccucucugggaa

SEQ ID NO: 1660 - RNA, 23 nt, Artificial Sequence
  source: /note="Description of Artificial Sequence: Synthetic oligonucleotide"
agcugcagcugggccacaaccgc

SEQ ID NO: 1661 - RNA, 23 nt, Artificial Sequence
  source: /note="Description of Artificial Sequence: Synthetic oligonucleotide"
uccgggagcuggaccugagcagg

SEQ ID NO: 1662 - RNA, 23 nt, Artificial Sequence
  source: /note="Description of Artificial Sequence: Synthetic oligonucleotide"
ggccgccugugucugcagcuacg

SEQ ID NO: 1663 - RNA, 23 nt, Artificial Sequence
  source: /note="Description of Artificial Sequence: Synthetic oligonucleotide"
cgucuucugcagcuccaggaacc

SEQ ID NO: 1664 - RNA, 23 nt, Artificial Sequence
  source: /note="Description of Artificial Sequence: Synthetic oligonucleotide"
agcuggcugagcgcagcuuugag

SEQ ID NO: 1665 - RNA, 23 nt, Artificial Sequence
  source: /note="Description of Artificial Sequence: Synthetic oligonucleotide"
agcucgaccugaccuccaaccag

SEQ ID NO: 1666 - RNA, 23 nt, Artificial Sequence
  source: /note="Description of Artificial Sequence: Synthetic oligonucleotide"
accucaaccucggcuggaauagc

SEQ ID NO: 1667 - RNA, 23 nt, Artificial Sequence
  source: /note="Description of Artificial Sequence: Synthetic oligonucleotide"
gggccuagagaaccugugccacc

SEQ ID NO: 1668 - RNA, 23 nt, Artificial Sequence
  source: /note="Description of Artificial Sequence: Synthetic oligonucleotide"
ggcagcuugaggugcucacgcua

SEQ ID NO: 1669 - RNA, 23 nt, Artificial Sequence
  source: /note="Description of Artificial Sequence: Synthetic oligonucleotide"
gacagguccucaguguccucagg

SEQ ID NO: 1670 - RNA, 23 nt, Artificial Sequence
  source: /note="Description of Artificial Sequence: Synthetic oligonucleotide"
gcgcugcgauggcuggaccuguc

SEQ ID NO: 1671 - RNA, 23 nt, Artificial Sequence
  source: /note="Description of Artificial Sequence: Synthetic oligonucleotide"
ugggcaagcuggaguaccugcug

SEQ ID NO: 1672 - DNA, 963 bp, Artificial Sequence
  source: /note="Description of Artificial Sequence: Synthetic polynucleotide"
ctcgagttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggttggccaaagacacatccaggaggggaacagaaggaggggacagaagcaagtctgcagatcagaggaaagaagaaagagcagaggagggagattggaagtagaaatgctgaatgcagaggcaaaaaaggaaaatgaaggacaggaggattaaacagacagaggcaaggatgatgagagaggagcagacagcaagaatgaaaagcagaaaatacaatagaggaaatgaagaaaagtaggcctgctggagctagatgatgatgtgatggaaatagaagtagcggccgc

SEQ ID NO: 1673 - DNA, 3361 bp, Artificial Sequence
  source: /note="Description of Artificial Sequence: Synthetic polynucleotide"
gcgatcgcgcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaagcggccgc

SEQ ID NO: 1674 - DNA, 3357 bp, Artificial Sequence
  source: /note="Description of Artificial Sequence: Synthetic polynucleotide"
gcgatcgcactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatcttgcggccgc

SEQ ID NO: 1675 - RNA, 21 nt, Artificial Sequence
  source: /note="Description of Artificial Sequence: Synthetic oligonucleotide"
aauguaacuaauugaaucaua

SEQ ID NO: 1676 - RNA, 21 nt, Artificial Sequence
  source: /note="Description of Artificial Sequence: Synthetic oligonucleotide"
uaagaaaguacuugacuaaaa

SEQ ID NO: 1677 - RNA, 21 nt, Artificial Sequence
  source: /note="Description of Artificial Sequence: Synthetic oligonucleotide"
cuuuauaauucuugaaugaga

SEQ ID NO: 1678 - RNA, 21 nt, Artificial Sequence
  source: /note="Description of Artificial Sequence: Synthetic oligonucleotide"
agauagaaauguauguuugaa

SEQ ID NO: 1679 - RNA, 21 nt, Artificial Sequence
  source: /note="Description of Artificial Sequence: Synthetic oligonucleotide"
uuccacaauccuuagaaucua

SEQ ID NO: 1680 - RNA, 21 nt, Artificial Sequence
  source: /note="Description of Artificial Sequence: Synthetic oligonucleotide"
uaucaaaaccuuucaaauaua

SEQ ID NO: 1681 - RNA, 21 nt, Artificial Sequence
  source: /note="Description of Artificial Sequence: Synthetic oligonucleotide"
acaaguaaacauuccaacaua

SEQ ID NO: 1682 - RNA, 21 nt, Artificial Sequence
  source: /note="Description of Artificial Sequence: Synthetic oligonucleotide"
acauagaaaguuucuucaaca

SEQ ID NO: 1683 - RNA, 21 nt, Artificial Sequence
  source: /note="Description of Artificial Sequence: Synthetic oligonucleotide"
cagucaacaaguauuuuaaca

SEQ ID NO: 1684 - RNA, 21 nt, Artificial Sequence
  source: /note="Description of Artificial Sequence: Synthetic oligonucleotide"
cucaagcugucuacuuacaua

SEQ ID NO: 1685 - RNA, 21 nt, Artificial Sequence
  source: /note="Description of Artificial Sequence: Synthetic oligonucleotide"
gaauuguuuccuuauuugcaa

SEQ ID NO: 1686 - RNA, 21 nt, Artificial Sequence
  source: /note="Description of Artificial Sequence: Synthetic oligonucleotide"
aucugucuuaguugaaaagca

SEQ ID NO: 1687 - RNA, 21 nt, Artificial Sequence
  source: /note="Description of Artificial Sequence: Synthetic oligonucleotide"
aauuagcaauauauuauccaa

SEQ ID NO: 1688 - RNA, 21 nt, Artificial Sequence
  source: /note="Description of Artificial Sequence: Synthetic oligonucleotide"
aauugaaucauuaucuuacaa

SEQ ID NO: 1689 - RNA, 21 nt, Artificial Sequence
  source: /note="Description of Artificial Sequence: Synthetic oligonucleotide"
uuuaucaauaauguucuauaa

SEQ ID NO: 1690 - RNA, 21 nt, Artificial Sequence
  source: /note="Description of Artificial Sequence: Synthetic oligonucleotide"
guaaaagaaacuauacaucaa

SEQ ID NO: 1691 - RNA, 21 nt, Artificial Sequence
  source: /note="Description of Artificial Sequence: Synthetic oligonucleotide"
aaugaggaauaauaaguuaaa

SEQ ID NO: 1692 - RNA, 21 nt, Artificial Sequence
  source: /note="Description of Artificial Sequence: Synthetic oligonucleotide"
cucugugaauguguuuuauca

SEQ ID NO: 1693 - RNA, 21 nt, Artificial Sequence
  source: /note="Description of Artificial Sequence: Synthetic oligonucleotide"
guuccuucaaaugaugaguua

SEQ ID NO: 1694 - RNA, 21 nt, Artificial Sequence
  source: /note="Description of Artificial Sequence: Synthetic oligonucleotide"
caggauaaagauaucaauuua

SEQ ID NO: 1695 - RNA, 21 nt, Artificial Sequence
  source: /note="Description of Artificial Sequence: Synthetic oligonucleotide"
cauguccuccucgcaucucua

SEQ ID NO: 1696 - RNA, 21 nt, Artificial Sequence
  source: /note="Description of Artificial Sequence: Synthetic oligonucleotide"
cauguccuccucgcaucucua

SEQ ID NO: 1697 - RNA, 21 nt, Artificial Sequence
  source: /note="Description of Artificial Sequence: Synthetic oligonucleotide"
uucaacaagcccacaggguaa

SEQ ID NO: 1698 - RNA, 21 nt, Artificial Sequence
  source: /note="Description of Artificial Sequence: Synthetic oligonucleotide"
uucaacaagcccacaggguaa

SEQ ID NO: 1699 - RNA, 21 nt, Artificial Sequence
  source: /note="Description of Artificial Sequence: Synthetic oligonucleotide"
uccucgcaucucuucuaccua

SEQ ID NO: 1700 - RNA, 21 nt, Artificial Sequence
  source: /note="Description of Artificial Sequence: Synthetic oligonucleotide"
uccucgcaucucuucuaccua

SEQ ID NO: 1701 - RNA, 21 nt, Artificial Sequence
  source: /note="Description of Artificial Sequence: Synthetic oligonucleotide"
ggggcuuuuauuucaacaaga

SEQ ID NO: 1702 - RNA, 21 nt, Artificial Sequence
  source: /note="Description of Artificial Sequence: Synthetic oligonucleotide"
ggggcuuuuauuucaacaaga

SEQ ID NO: 1703 - RNA, 21 nt, Artificial Sequence
  source: /note="Description of Artificial Sequence: Synthetic oligonucleotide"
gaugcucuucaguucguguga

SEQ ID NO: 1704 - RNA, 21 nt, Artificial Sequence
  source: /note="Description of Artificial Sequence: Synthetic oligonucleotide"
gaugcucuucaguucguguga

SEQ ID NO: 1705 - RNA, 21 nt, Artificial Sequence
  source: /note="Description of Artificial Sequence: Synthetic oligonucleotide"
uggaugcucuucaguucguga

SEQ ID NO: 1706 - RNA, 21 nt, Artificial Sequence
  source: /note="Description of Artificial Sequence: Synthetic oligonucleotide"
uggaugcucuucaguucguga

SEQ ID NO: 1707 - RNA, 21 nt, Artificial Sequence
  source: /note="Description of Artificial Sequence: Synthetic oligonucleotide"
gguggaugcucuucaguucga

SEQ ID NO: 1708 - RNA, 21 nt, Artificial Sequence
  source: /note="Description of Artificial Sequence: Synthetic oligonucleotide"
gguggaugcucuucaguucga

SEQ ID NO: 1709 - RNA, 21 nt, Artificial Sequence
  source: /note="Description of Artificial Sequence: Synthetic oligonucleotide"
gcugguggaugcucuucagua

SEQ ID NO: 1710 - RNA, 21 nt, Artificial Sequence
  source: /note="Description of Artificial Sequence: Synthetic oligonucleotide"
gcugguggaugcucuucagua

SEQ ID NO: 1711 - RNA, 21 nt, Artificial Sequence
  source: /note="Description of Artificial Sequence: Synthetic oligonucleotide"
cugguggaugcucuucaguua

SEQ ID NO: 1712 - RNA, 21 nt, Artificial Sequence
  source: /note="Description of Artificial Sequence: Synthetic oligonucleotide"
cugguggaugcucuucaguua

SEQ ID NO: 1713 - RNA, 21 nt, Artificial Sequence
  source: /note="Description of Artificial Sequence: Synthetic oligonucleotide"
ccaaaaugcacugauguaaaa

SEQ ID NO: 1714 - RNA, 21 nt, Artificial Sequence
  source: /note="Description of Artificial Sequence: Synthetic oligonucleotide"
uccaguugcacuaaauuccua

SEQ ID NO: 1715 - RNA, 21 nt, Artificial Sequence
  source: /note="Description of Artificial Sequence: Synthetic oligonucleotide"
cauucuucaacuaucuuugaa

SEQ ID NO: 1716 - RNA, 21 nt, Artificial Sequence
  source: /note="Description of Artificial Sequence: Synthetic oligonucleotide"
acauuccaacauugucuuuaa

SEQ ID NO: 1717 - RNA, 21 nt, Artificial Sequence
  source: /note="Description of Artificial Sequence: Synthetic oligonucleotide"
ggcuuagaauaaaagauguaa

SEQ ID NO: 1718 - RNA, 21 nt, Artificial Sequence
  source: /note="Description of Artificial Sequence: Synthetic oligonucleotide"
uuucaagauauuuguaaaaga

SEQ ID NO: 1719 - RNA, 21 nt, Artificial Sequence
  source: /note="Description of Artificial Sequence: Synthetic oligonucleotide"
auaagcauauuuugaaaauga

SEQ ID NO: 1720 - RNA, 21 nt, Artificial Sequence
  source: /note="Description of Artificial Sequence: Synthetic oligonucleotide"
guuuucaaugcuaguguuuaa

SEQ ID NO: 1721 - RNA, 21 nt, Artificial Sequence
  source: /note="Description of Artificial Sequence: Synthetic oligonucleotide"
caaugaaauacacaaguaaaa

SEQ ID NO: 1722 - RNA, 21 nt, Artificial Sequence
  source: /note="Description of Artificial Sequence: Synthetic oligonucleotide"
caaaaguccacugaugcaaaa

SEQ ID NO: 1723 - RNA, 21 nt, Artificial Sequence
  source: /note="Description of Artificial Sequence: Synthetic oligonucleotide"
aacauagaaaguuucuucaaa

SEQ ID NO: 1724 - RNA, 21 nt, Artificial Sequence
  source: /note="Description of Artificial Sequence: Synthetic oligonucleotide"
aaccuaauuaguaacuuucca

SEQ ID NO: 1725 - RNA, 21 nt, Artificial Sequence
  source: /note="Description of Artificial Sequence: Synthetic oligonucleotide"
gacuuauuuccuucacuuaaa

SEQ ID NO: 1726 - RNA, 21 nt, Artificial Sequence
  source: /note="Description of Artificial Sequence: Synthetic oligonucleotide"
ggcucucaaacuuagcaaaaa

SEQ ID NO: 1727 - RNA, 21 nt, Artificial Sequence
  source: /note="Description of Artificial Sequence: Synthetic oligonucleotide"
acaaagauaagugaaaagaga

SEQ ID NO: 1728 - RNA, 21 nt, Artificial Sequence
  source: /note="Description of Artificial Sequence: Synthetic oligonucleotide"
guaguguacuguucaccaaaa

SEQ ID NO: 1729 - RNA, 21 nt, Artificial Sequence
  source: /note="Description of Artificial Sequence: Synthetic oligonucleotide"
ucaccaacucauagcaaagua

SEQ ID NO: 1730 - RNA, 21 nt, Artificial Sequence
  source: /note="Description of Artificial Sequence: Synthetic oligonucleotide"
aaaauaacucauuauaccaaa

SEQ ID NO: 1731 - RNA, 21 nt, Artificial Sequence
  source: /note="Description of Artificial Sequence: Synthetic oligonucleotide"
aagaaagaaucuuuccauuca

SEQ ID NO: 1732 - RNA, 21 nt, Artificial Sequence
  source: /note="Description of Artificial Sequence: Synthetic oligonucleotide"
auuucaagauauuuguaaaaa

SEQ ID NO: 1733 - RNA, 21 nt, Artificial Sequence
  source: /note="Description of Artificial Sequence: Synthetic oligonucleotide"
agcugaaacucuagaauuaaa

SEQ ID NO: 1734 - RNA, 21 nt, Artificial Sequence
  source: /note="Description of Artificial Sequence: Synthetic oligonucleotide"
aaagauaaaucugauuuauga

SEQ ID NO: 1735 - RNA, 21 nt, Artificial Sequence
  source: /note="Description of Artificial Sequence: Synthetic oligonucleotide"
uauuaaauuaauucugauuga

SEQ ID NO: 1736 - RNA, 21 nt, Artificial Sequence
  source: /note="Description of Artificial Sequence: Synthetic oligonucleotide"
aagaaugagcuuucaacucaa

SEQ ID NO: 1737 - RNA, 21 nt, Artificial Sequence
  source: /note="Description of Artificial Sequence: Synthetic oligonucleotide"
guuugauaacauuuaaaagaa

SEQ ID NO: 1738 - RNA, 21 nt, Artificial Sequence
  source: /note="Description of Artificial Sequence: Synthetic oligonucleotide"
uguuuuaaacauagaaaguua

SEQ ID NO: 1739 - RNA, 21 nt, Artificial Sequence
  source: /note="Description of Artificial Sequence: Synthetic oligonucleotide"
uaaauaacccauucauagcaa

SEQ ID NO: 1740 - RNA, 21 nt, Artificial Sequence
  source: /note="Description of Artificial Sequence: Synthetic oligonucleotide"
cacauagacucuuuaaaacua

SEQ ID NO: 1741 - RNA, 21 nt, Artificial Sequence
  source: /note="Description of Artificial Sequence: Synthetic oligonucleotide"
aagucacaaaguuaucuucua

SEQ ID NO: 1742 - RNA, 21 nt, Artificial Sequence
  source: /note="Description of Artificial Sequence: Synthetic oligonucleotide"
uaaagaaagaauuuaugagaa

SEQ ID NO: 1743 - RNA, 21 nt, Artificial Sequence
  source: /note="Description of Artificial Sequence: Synthetic oligonucleotide"
gaaauguauguuugacuugua

SEQ ID NO: 1744 - RNA, 21 nt, Artificial Sequence
  source: /note="Description of Artificial Sequence: Synthetic oligonucleotide"
uuuauaagaccuuccuguuaa

SEQ ID NO: 1745 - RNA, 21 nt, Artificial Sequence
  source: /note="Description of Artificial Sequence: Synthetic oligonucleotide"
cugugaauguguuuuauccaa

SEQ ID NO: 1746 - RNA, 21 nt, Artificial Sequence
  source: /note="Description of Artificial Sequence: Synthetic oligonucleotide"
uuaauucugauuguauuugaa

SEQ ID NO: 1747 - RNA, 21 nt, Artificial Sequence
  source: /note="Description of Artificial Sequence: Synthetic oligonucleotide"
ugucaucuaccuaccucaaaa

SEQ ID NO: 1748 - RNA, 21 nt, Artificial Sequence
  source: /note="Description of Artificial Sequence: Synthetic oligonucleotide"
cgugaaagcaaaacaauagga

SEQ ID NO: 1749 - RNA, 21 nt, Artificial Sequence
  source: /note="Description of Artificial Sequence: Synthetic oligonucleotide"
aacaacaauucuauagauaga

SEQ ID NO: 1750 - RNA, 21 nt, Artificial Sequence
  source: /note="Description of Artificial Sequence: Synthetic oligonucleotide"
uaaaguauuauuugaacuuua

SEQ ID NO: 1751 - RNA, 21 nt, Artificial Sequence
  source: /note="Description of Artificial Sequence: Synthetic oligonucleotide"
agaaagaauuuaugagaaaua

SEQ ID NO: 1752 - RNA, 21 nt, Artificial Sequence
  source: /note="Description of Artificial Sequence: Synthetic oligonucleotide"
aaaugcacugauguaaaguaa

SEQ ID NO: 1753 - RNA, 21 nt, Artificial Sequence
  source: /note="Description of Artificial Sequence: Synthetic oligonucleotide"
auuaauucugauuguauuuga

SEQ ID NO: 1754 - RNA, 21 nt, Artificial Sequence
  source: /note="Description of Artificial Sequence: Synthetic oligonucleotide"
caauaauguucuauagaaaaa

SEQ ID NO: 1755 - RNA, 21 nt, Artificial Sequence
  source: /note="Description of Artificial Sequence: Synthetic oligonucleotide"
gauuuucaauuugauuuugaa

SEQ ID NO: 1756 - RNA, 21 nt, Artificial Sequence
  source: /note="Description of Artificial Sequence: Synthetic oligonucleotide"
uugauuuugaauucugcauua

SEQ ID NO: 1757 - RNA, 21 nt, Artificial Sequence
  source: /note="Description of Artificial Sequence: Synthetic oligonucleotide"
uuucaauuugauuuugaauua

SEQ ID NO: 1758 - RNA, 21 nt, Artificial Sequence
  source: /note="Description of Artificial Sequence: Synthetic oligonucleotide"
gugucuguguaucaugaaaaa

SEQ ID NO: 1759 - RNA, 21 nt, Artificial Sequence
  source: /note="Description of Artificial Sequence: Synthetic oligonucleotide"
gguuuuaugaauacaaagaua

SEQ ID NO: 1760 - RNA, 21 nt, Artificial Sequence
  source: /note="Description of Artificial Sequence: Synthetic oligonucleotide"
gcagaucaagauuuucucaua

SEQ ID NO: 1761 - RNA, 21 nt, Artificial Sequence
  source: /note="Description of Artificial Sequence: Synthetic oligonucleotide"
aacuaauugaaucauuaucua

SEQ ID NO: 1762 - RNA, 21 nt, Artificial Sequence
  source: /note="Description of Artificial Sequence: Synthetic oligonucleotide"
ugguuuaugaauuguuuccua

SEQ ID NO: 1763 - RNA, 21 nt, Artificial Sequence
  source: /note="Description of Artificial Sequence: Synthetic oligonucleotide"
uaguauaauggugcuauuuua

SEQ ID NO: 1764 - RNA, 21 nt, Artificial Sequence
  source: /note="Description of Artificial Sequence: Synthetic oligonucleotide"
cuguuuaauaagcauauuuua

SEQ ID NO: 1765 - RNA, 21 nt, Artificial Sequence
  source: /note="Description of Artificial Sequence: Synthetic oligonucleotide"
aaauaucaaaaccuuucaaaa

SEQ ID NO: 1766 - RNA, 21 nt, Artificial Sequence
  source: /note="Description of Artificial Sequence: Synthetic oligonucleotide"
acagauguaaaagaaacuaua

SEQ ID NO: 1767 - RNA, 21 nt, Artificial Sequence
  source: /note="Description of Artificial Sequence: Synthetic oligonucleotide"
aacuuugaggccaaucauuua

SEQ ID NO: 1768 - RNA, 23 nt, Artificial Sequence
  source: /note="Description of Artificial Sequence: Synthetic oligonucleotide"
uaugauucaauuaguuacauuuu

SEQ ID NO: 1769 - RNA, 23 nt, Artificial Sequence
  source: /note="Description of Artificial Sequence: Synthetic oligonucleotide"
uuuuagucaaguacuuucuuaaa

SEQ ID NO: 1770 - RNA, 23 nt, Artificial Sequence
  source: /note="Description of Artificial Sequence: Synthetic oligonucleotide"
ucucauucaagaauuauaaagca

SEQ ID NO: 1771 - RNA, 23 nt, Artificial Sequence
  source: /note="Description of Artificial Sequence: Synthetic oligonucleotide"
uucaaacauacauuucuaucuag

SEQ ID NO: 1772 - RNA, 23 nt, Artificial Sequence
  source: /note="Description of Artificial Sequence: Synthetic oligonucleotide"
uagauucuaaggauuguggaagg

SEQ ID NO: 1773 - RNA, 23 nt, Artificial Sequence
  source: /note="Description of Artificial Sequence: Synthetic oligonucleotide"
uauauuugaaagguuuugauauu

SEQ ID NO: 1774 - RNA, 23 nt, Artificial Sequence
  source: /note="Description of Artificial Sequence: Synthetic oligonucleotide"
uauguuggaauguuuacuugugu

SEQ ID NO: 1775 - RNA, 23 nt, Artificial Sequence
  source: /note="Description of Artificial Sequence: Synthetic oligonucleotide"
uguugaagaaacuuucuauguuu

SEQ ID NO: 1776 - RNA, 23 nt, Artificial Sequence
  source: /note="Description of Artificial Sequence: Synthetic oligonucleotide"
uguuaaaauacuuguugacugaa

SEQ ID NO: 1777 - RNA, 23 nt, Artificial Sequence
  source: /note="Description of Artificial Sequence: Synthetic oligonucleotide"
uauguaaguagacagcuugaggu

SEQ ID NO: 1778 - RNA, 23 nt, Artificial Sequence
  source: /note="Description of Artificial Sequence: Synthetic oligonucleotide"
uugcaaauaaggaaacaauucau

SEQ ID NO: 1779 - RNA, 23 nt, Artificial Sequence
  source: /note="Description of Artificial Sequence: Synthetic oligonucleotide"
ugcuuuucaacuaagacagaugu

SEQ ID NO: 1780 - RNA, 23 nt, Artificial Sequence
  source: /note="Description of Artificial Sequence: Synthetic oligonucleotide"
uuggauaauauauugcuaauuuu

SEQ ID NO: 1781 - RNA, 23 nt, Artificial Sequence
  source: /note="Description of Artificial Sequence: Synthetic oligonucleotide"
uuguaagauaaugauucaauuag

SEQ ID NO: 1782 - RNA, 23 nt, Artificial Sequence
  source: /note="Description of Artificial Sequence: Synthetic oligonucleotide"
uuauagaacauuauugauaaaag

SEQ ID NO: 1783 - RNA, 23 nt, Artificial Sequence
  source: /note="Description of Artificial Sequence: Synthetic oligonucleotide"
uugauguauaguuucuuuuacau

SEQ ID NO: 1784 - RNA, 23 nt, Artificial Sequence
  source: /note="Description of Artificial Sequence: Synthetic oligonucleotide"
uuuaacuuauuauuccucauucu

SEQ ID NO: 1785 - RNA, 23 nt, Artificial Sequence
  source: /note="Description of Artificial Sequence: Synthetic oligonucleotide"
ugauaaaacacauucacagagag

SEQ ID NO: 1786 - RNA, 23 nt, Artificial Sequence
  source: /note="Description of Artificial Sequence: Synthetic oligonucleotide"
uaacucaucauuugaaggaacuc

SEQ ID NO: 1787 - RNA, 23 nt, Artificial Sequence
  source: /note="Description of Artificial Sequence: Synthetic oligonucleotide"
uaaauugauaucuuuauccugua

SEQ ID NO: 1788 - RNA, 23 nt, Artificial Sequence
  source: /note="Description of Artificial Sequence: Synthetic oligonucleotide"
uagagaugcgaggaggacauggu

SEQ ID NO: 1789 - RNA, 23 nt, Artificial Sequence
  source: /note="Description of Artificial Sequence: Synthetic oligonucleotide"
uagagaugcgaggaggacauggu

SEQ ID NO: 1790 - RNA, 23 nt, Artificial Sequence
  source: /note="Description of Artificial Sequence: Synthetic oligonucleotide"
uuacccugugggcuuguugaaau

SEQ ID NO: 1791 - RNA, 23 nt, Artificial Sequence
  source: /note="Description of Artificial Sequence: Synthetic oligonucleotide"
uuacccugugggcuuguugaaau

SEQ ID NO: 1792 - RNA, 23 nt, Artificial Sequence
  source: /note="Description of Artificial Sequence: Synthetic oligonucleotide"
uagguagaagagaugcgaggagg

SEQ ID NO: 1793 - RNA, 23 nt, Artificial Sequence
  source: /note="Description of Artificial Sequence: Synthetic oligonucleotide"
uagguagaagagaugcgaggagg

SEQ ID NO: 1794 - RNA, 23 nt, Artificial Sequence
  source: /note="Description of Artificial Sequence: Synthetic oligonucleotide"
ucuuguugaaauaaaagccccug

SEQ ID NO: 1795 - RNA, 23 nt, Artificial Sequence
  source: /note="Description of Artificial Sequence: Synthetic oligonucleotide"
ucuuguugaaauaaaagccccug

SEQ ID NO: 1796 - RNA, 23 nt, Artificial Sequence
  source: /note="Description of Artificial Sequence: Synthetic oligonucleotide"
ucacacgaacugaagagcaucca

SEQ ID NO: 1797 - RNA, 23 nt, Artificial Sequence
  source: /note="Description of Artificial Sequence: Synthetic oligonucleotide"
ucacacgaacugaagagcaucca

SEQ ID NO: 1798 - RNA, 23 nt, Artificial Sequence
  source: /note="Description of Artificial Sequence: Synthetic oligonucleotide"
ucacgaacugaagagcauccacc

SEQ ID NO: 1799 - RNA, 23 nt, Artificial Sequence
  source: /note="Description of Artificial Sequence: Synthetic oligonucleotide"
ucacgaacugaagagcauccacc

SEQ ID NO: 1800 - RNA, 23 nt, Artificial Sequence
  source: /note="Description of Artificial Sequence: Synthetic oligonucleotide"
ucgaacugaagagcauccaccag

SEQ ID NO: 1801 - RNA, 23 nt, Artificial Sequence
  source: /note="Description of Artificial Sequence: Synthetic oligonucleotide"
ucgaacugaagagcauccaccag

SEQ ID NO: 1802 - RNA, 23 nt, Artificial Sequence
  source: /note="Description of Artificial Sequence: Synthetic oligonucleotide"
uacugaagagcauccaccagcuc

SEQ ID NO: 1803 - RNA, 23 nt, Artificial Sequence
  source: /note="Description of Artificial Sequence: Synthetic oligonucleotide"
uacugaagagcauccaccagcuc

SEQ ID NO: 1804 - RNA, 23 nt, Artificial Sequence
  source: /note="Description of Artificial Sequence: Synthetic oligonucleotide"
uaacugaagagcauccaccagcu

SEQ ID NO: 1805 - RNA, 23 nt, Artificial Sequence
  source: /note="Description of Artificial Sequence: Synthetic oligonucleotide"
uaacugaagagcauccaccagcu

SEQ ID NO: 1806 - RNA, 23 nt, Artificial Sequence
  source: /note="Description of Artificial Sequence: Synthetic oligonucleotide"
uuuuacaucagugcauuuugggc

SEQ ID NO: 1807 - RNA, 23 nt, Artificial Sequence
  source: /note="Description of Artificial Sequence: Synthetic oligonucleotide"
uaggaauuuagugcaacuggauc

SEQ ID NO: 1808 - RNA, 23 nt, Artificial Sequence
  source: /note="Description of Artificial Sequence: Synthetic oligonucleotide"
uucaaagauaguugaagaaugag

SEQ ID NO: 1809 - RNA, 23 nt, Artificial Sequence
  source: /note="Description of Artificial Sequence: Synthetic oligonucleotide"
uuaaagacaauguuggaauguuu

SEQ ID NO: 1810 - RNA, 23 nt, Artificial Sequence
  source: /note="Description of Artificial Sequence: Synthetic oligonucleotide"
uuacaucuuuuauucuaagccuu

SEQ ID NO: 1811 - RNA, 23 nt, Artificial Sequence
  source: /note="Description of Artificial Sequence: Synthetic oligonucleotide"
ucuuuuacaaauaucuugaaauu

SEQ ID NO: 1812 - RNA, 23 nt, Artificial Sequence
  source: /note="Description of Artificial Sequence: Synthetic oligonucleotide"
ucauuuucaaaauaugcuuauua

SEQ ID NO: 1813 - RNA, 23 nt, Artificial Sequence
  source: /note="Description of Artificial Sequence: Synthetic oligonucleotide"
uuaaacacuagcauugaaaacaa

SEQ ID NO: 1814 - RNA, 23 nt, Artificial Sequence
  source: /note="Description of Artificial Sequence: Synthetic oligonucleotide"
uuuuacuuguguauuucauuggg

SEQ ID NO: 1815 - RNA, 23 nt, Artificial Sequence
  source: /note="Description of Artificial Sequence: Synthetic oligonucleotide"
uuuugcaucaguggacuuuugug

SEQ ID NO: 1816 - RNA, 23 nt, Artificial Sequence
  source: /note="Description of Artificial Sequence: Synthetic oligonucleotide"
uuugaagaaacuuucuauguuua

SEQ ID NO: 1817 - RNA, 23 nt, Artificial Sequence
  source: /note="Description of Artificial Sequence: Synthetic oligonucleotide"
uggaaaguuacuaauuagguugc

SEQ ID NO: 1818 - RNA, 23 nt, Artificial Sequence
  source: /note="Description of Artificial Sequence: Synthetic oligonucleotide"
uuuaagugaaggaaauaagucau

SEQ ID NO: 1819 - RNA, 23 nt, Artificial Sequence
  source: /note="Description of Artificial Sequence: Synthetic oligonucleotide"
uuuuugcuaaguuugagagccaa

SEQ ID NO: 1820 - RNA, 23 nt, Artificial Sequence
  source: /note="Description of Artificial Sequence: Synthetic oligonucleotide"
ucucuuuucacuuaucuuuguau

SEQ ID NO: 1821 - RNA, 23 nt, Artificial Sequence
  source: /note="Description of Artificial Sequence: Synthetic oligonucleotide"
uuuuggugaacaguacacuacuu

SEQ ID NO: 1822 - RNA, 23 nt, Artificial Sequence
  source: /note="Description of Artificial Sequence: Synthetic oligonucleotide"
uacuuugcuaugaguuggugagu

SEQ ID NO: 1823 - RNA, 23 nt, Artificial Sequence
  source: /note="Description of Artificial Sequence: Synthetic oligonucleotide"
uuugguauaaugaguuauuuuca

SEQ ID NO: 1824 - RNA, 23 nt, Artificial Sequence
  source: /note="Description of Artificial Sequence: Synthetic oligonucleotide"
ugaauggaaagauucuuucuucu

SEQ ID NO: 1825 - RNA, 23 nt, Artificial Sequence
  source: /note="Description of Artificial Sequence: Synthetic oligonucleotide"
uuuuuacaaauaucuugaaauug

SEQ ID NO: 1826 - RNA, 23 nt, Artificial Sequence
  source: /note="Description of Artificial Sequence: Synthetic oligonucleotide"
uuuaauucuagaguuucagcuug

SEQ ID NO: 1827 - RNA, 23 nt, Artificial Sequence
  source: /note="Description of Artificial Sequence: Synthetic oligonucleotide"
ucauaaaucagauuuaucuuuug

SEQ ID NO: 1828 - RNA, 23 nt, Artificial Sequence
  source: /note="Description of Artificial Sequence: Synthetic oligonucleotide"
ucaaucagaauuaauuuaauaaa

SEQ ID NO: 1829 - RNA, 23 nt, Artificial Sequence
  source: /note="Description of Artificial Sequence: Synthetic oligonucleotide"
uugaguugaaagcucauucuuac

SEQ ID NO: 1830 - RNA, 23 nt, Artificial Sequence
  source: /note="Description of Artificial Sequence: Synthetic oligonucleotide"
uucuuuuaaauguuaucaaacuu

SEQ ID NO: 1831 - RNA, 23 nt, Artificial Sequence
  source: /note="Description of Artificial Sequence: Synthetic oligonucleotide"
uaacuuucuauguuuaaaacaua

SEQ ID NO: 1832 - RNA, 23 nt, Artificial Sequence
  source: /note="Description of Artificial Sequence: Synthetic oligonucleotide"
uugcuaugaauggguuauuuaua

SEQ ID NO: 1833 - RNA, 23 nt, Artificial Sequence
  source: /note="Description of Artificial Sequence: Synthetic oligonucleotide"
uaguuuuaaagagucuauguggg

SEQ ID NO: 1834 - RNA, 23 nt, Artificial Sequence
  source: /note="Description of Artificial Sequence: Synthetic oligonucleotide"
uagaagauaacuuugugacuuuu

SEQ ID NO: 1835 - RNA, 23 nt, Artificial Sequence
  source: /note="Description of Artificial Sequence: Synthetic oligonucleotide"
uucucauaaauucuuucuuuauc

SEQ ID NO: 1836 - RNA, 23 nt, Artificial Sequence
  source: /note="Description of Artificial Sequence: Synthetic oligonucleotide"
uacaagucaaacauacauuucua

SEQ ID NO: 1837 - RNA, 23 nt, Artificial Sequence
  source: /note="Description of Artificial Sequence: Synthetic oligonucleotide"
uuaacaggaaggucuuauaaaau

SEQ ID NO: 1838 - RNA, 23 nt, Artificial Sequence
  source: /note="Description of Artificial Sequence: Synthetic oligonucleotide"
uuggauaaaacacauucacagag

SEQ ID NO: 1839 - RNA, 23 nt, Artificial Sequence
  source: /note="Description of Artificial Sequence: Synthetic oligonucleotide"
uucaaauacaaucagaauuaauu

SEQ ID NO: 1840 - RNA, 23 nt, Artificial Sequence
  source: /note="Description of Artificial Sequence: Synthetic oligonucleotide"
uuuugagguagguagaugacaua

SEQ ID NO: 1841 - RNA, 23 nt, Artificial Sequence
  source: /note="Description of Artificial Sequence: Synthetic oligonucleotide"
uccuauuguuuugcuuucacgua

SEQ ID NO: 1842 - RNA, 23 nt, Artificial Sequence
  source: /note="Description of Artificial Sequence: Synthetic oligonucleotide"
ucuaucuauagaauuguuguuuu

SEQ ID NO: 1843 - RNA, 23 nt, Artificial Sequence
  source: /note="Description of Artificial Sequence: Synthetic oligonucleotide"
uaaaguucaaauaauacuuuaau

SEQ ID NO: 1844 - RNA, 23 nt, Artificial Sequence
  source: /note="Description of Artificial Sequence: Synthetic oligonucleotide"
uauuucucauaaauucuuucuuu

SEQ ID NO: 1845 - RNA, 23 nt, Artificial Sequence
  source: /note="Description of Artificial Sequence: Synthetic oligonucleotide"
uuacuuuacaucagugcauuuug

SEQ ID NO: 1846 - RNA, 23 nt, Artificial Sequence
  source: /note="Description of Artificial Sequence: Synthetic oligonucleotide"
ucaaauacaaucagaauuaauuu

SEQ ID NO: 1847 - RNA, 23 nt, Artificial Sequence
  source: /note="Description of Artificial Sequence: Synthetic oligonucleotide"
uuuuucuauagaacauuauugau

SEQ ID NO: 1848 - RNA, 23 nt, Artificial Sequence
  source: /note="Description of Artificial Sequence: Synthetic oligonucleotide"
uucaaaaucaaauugaaaaucaa

SEQ ID NO: 1849 - RNA, 23 nt, Artificial Sequence
  source: /note="Description of Artificial Sequence: Synthetic oligonucleotide"
uaaugcagaauucaaaaucaaau

SEQ ID NO: 1850 - RNA, 23 nt, Artificial Sequence
  source: /note="Description of Artificial Sequence: Synthetic oligonucleotide"
uaauucaaaaucaaauugaaaau

SEQ ID NO: 1851 - RNA, 23 nt, Artificial Sequence
  source: /note="Description of Artificial Sequence: Synthetic oligonucleotide"
uuuuucaugauacacagacacag

SEQ ID NO: 1852 - RNA, 23 nt, Artificial Sequence
  source: /note="Description of Artificial Sequence: Synthetic oligonucleotide"
uaucuuuguauucauaaaaccaa

SEQ ID NO: 1853 - RNA, 23 nt, Artificial Sequence
  source: /note="Description of Artificial Sequence: Synthetic oligonucleotide"
uaugagaaaaucuugaucugcag

SEQ ID NO: 1854 - RNA, 23 nt, Artificial Sequence
  source: /note="Description of Artificial Sequence: Synthetic oligonucleotide"
uagauaaugauucaauuaguuac

SEQ ID NO: 1855 - RNA, 23 nt, Artificial Sequence
  source: /note="Description of Artificial Sequence: Synthetic oligonucleotide"
uaggaaacaauucauaaaccacu

SEQ ID NO: 1856 - RNA, 23 nt, Artificial Sequence
  source: /note="Description of Artificial Sequence: Synthetic oligonucleotide"
uaaaauagcaccauuauacuaaa

SEQ ID NO: 1857 - RNA, 23 nt, Artificial Sequence
  source: /note="Description of Artificial Sequence: Synthetic oligonucleotide"
uaaaauaugcuuauuaaacagua

SEQ ID NO: 1858 - RNA, 23 nt, Artificial Sequence
  source: /note="Description of Artificial Sequence: Synthetic oligonucleotide"
uuuugaaagguuuugauauuuug

SEQ ID NO: 1859 - RNA, 23 nt, Artificial Sequence
  source: /note="Description of Artificial Sequence: Synthetic oligonucleotide"
uauaguuucuuuuacaucugucc

SEQ ID NO: 1860 - RNA, 23 nt, Artificial Sequence
  source: /note="Description of Artificial Sequence: Synthetic oligonucleotide"
uaaaugauuggccucaaaguugc

SEQ ID NO: 1861 - RNA, 21 nt, Artificial Sequence
  source: /note="Description of Artificial Sequence: Synthetic oligonucleotide"
aauguaacuaauugaaucaua

SEQ ID NO: 1862 - RNA, 21 nt, Artificial Sequence
  source: /note="Description of Artificial Sequence: Synthetic oligonucleotide"
uaagaaaguacuugacuaaaa

SEQ ID NO: 1863 - RNA, 21 nt, Artificial Sequence
  source: /note="Description of Artificial Sequence: Synthetic oligonucleotide"
cuuuauaauucuugaaugaga

SEQ ID NO: 1864 - RNA, 21 nt, Artificial Sequence
  source: /note="Description of Artificial Sequence: Synthetic oligonucleotide"
agauagaaauguauguuugaa

SEQ ID NO: 1865 - RNA, 21 nt, Artificial Sequence
  source: /note="Description of Artificial Sequence: Synthetic oligonucleotide"
uuccacaauccuuagaaucua

SEQ ID NO: 1866 - RNA, 21 nt, Artificial Sequence
  source: /note="Description of Artificial Sequence: Synthetic oligonucleotide"
uaucaaaaccuuucaaauaua

SEQ ID NO: 1867 - RNA, 21 nt, Artificial Sequence
  source: /note="Description of Artificial Sequence: Synthetic oligonucleotide"
acaaguaaacauuccaacaua

SEQ ID NO: 1868 - RNA, 21 nt, Artificial Sequence
  source: /note="Description of Artificial Sequence: Synthetic oligonucleotide"
acauagaaaguuucuucaaca

SEQ ID NO: 1869 - RNA, 21 nt, Artificial Sequence
  source: /note="Description of Artificial Sequence: Synthetic oligonucleotide"
cagucaacaaguauuuuaaca

SEQ ID NO: 1870 - RNA, 21 nt, Artificial Sequence
  source: /note="Description of Artificial Sequence: Synthetic oligonucleotide"
cucaagcugucuacuuacaua

SEQ ID NO: 1871 - RNA, 21 nt, Artificial Sequence
  source: /note="Description of Artificial Sequence: Synthetic oligonucleotide"
gaauuguuuccuuauuugcaa

SEQ ID NO: 1872 - RNA, 21 nt, Artificial Sequence
  source: /note="Description of Artificial Sequence: Synthetic oligonucleotide"
aucugucuuaguugaaaagca

SEQ ID NO: 1873 - RNA, 21 nt, Artificial Sequence
  source: /note="Description of Artificial Sequence: Synthetic oligonucleotide"
aauuagcaauauauuauccaa

SEQ ID NO: 1874 - RNA, 21 nt, Artificial Sequence
  source: /note="Description of Artificial Sequence: Synthetic oligonucleotide"
aauugaaucauuaucuuacaa

SEQ ID NO: 1875 - RNA, 21 nt, Artificial Sequence
  source: /note="Description of Artificial Sequence: Synthetic oligonucleotide"
uuuaucaauaauguucuauaa

SEQ ID NO: 1876 - RNA, 21 nt, Artificial Sequence
  source: /note="Description of Artificial Sequence: Synthetic oligonucleotide"
guaaaagaaacuauacaucaa

SEQ ID NO: 1877 - RNA, 21 nt, Artificial Sequence
  source: /note="Description of Artificial Sequence: Synthetic oligonucleotide"
aaugaggaauaauaaguuaaa

SEQ ID NO: 1878 - RNA, 21 nt, Artificial Sequence
  source: /note="Description of Artificial Sequence: Synthetic oligonucleotide"
cucugugaauguguuuuauca

SEQ ID NO: 1879 - RNA, 21 nt, Artificial Sequence
  source: /note="Description of Artificial Sequence: Synthetic oligonucleotide"
guuccuucaaaugaugaguua

SEQ ID NO: 1880 - RNA, 21 nt, Artificial Sequence
  source: /note="Description of Artificial Sequence: Synthetic oligonucleotide"
caggauaaagauaucaauuua

SEQ ID NO: 1881 - RNA, 21 nt, Artificial Sequence
  source: /note="Description of Artificial Sequence: Synthetic oligonucleotide"
cauguccuccucgcaucucua

SEQ ID NO: 1882 - RNA, 21 nt, Artificial Sequence
  source: /note="Description of Artificial Sequence: Synthetic oligonucleotide"
cauguccuccucgcaucucua

SEQ ID NO: 1883 - RNA, 21 nt, Artificial Sequence
  source: /note="Description of Artificial Sequence: Synthetic oligonucleotide"
uucaacaagcccacaggguaa

SEQ ID NO: 1884 - RNA, 21 nt, Artificial Sequence
  source: /note="Description of Artificial Sequence: Synthetic oligonucleotide"
uucaacaagcccacaggguaa

SEQ ID NO: 1885 - RNA, 21 nt, Artificial Sequence
  source: /note="Description of Artificial Sequence: Synthetic oligonucleotide"
uccucgcaucucuucuaccua

SEQ ID NO: 1886 - RNA, 21 nt, Artificial Sequence
  source: /note="Description of Artificial Sequence: Synthetic oligonucleotide"
uccucgcaucucuucuaccua

SEQ ID NO: 1887 - RNA, 21 nt, Artificial Sequence
  source: /note="Description of Artificial Sequence: Synthetic oligonucleotide"
ggggcuuuuauuucaacaaga

SEQ ID NO: 1888 - RNA, 21 nt, Artificial Sequence
  source: /note="Description of Artificial Sequence: Synthetic oligonucleotide"
ggggcuuuuauuucaacaaga

SEQ ID NO: 1889 - RNA, 21 nt, Artificial Sequence
  source: /note="Description of Artificial Sequence: Synthetic oligonucleotide"
gaugcucuucaguucguguga

SEQ ID NO: 1890 - RNA, 21 nt, Artificial Sequence
  source: /note="Description of Artificial Sequence: Synthetic oligonucleotide"
gaugcucuucaguucguguga

SEQ ID NO: 1891 - RNA, 21 nt, Artificial Sequence
  source: /note="Description of Artificial Sequence: Synthetic oligonucleotide"
uggaugcucuucaguucguga

SEQ ID NO: 1892 - RNA, 21 nt, Artificial Sequence
  source: /note="Description of Artificial Sequence: Synthetic oligonucleotide"
uggaugcucuucaguucguga

SEQ ID NO: 1893 - RNA, 21 nt, Artificial Sequence
  source: /note="Description of Artificial Sequence: Synthetic oligonucleotide"
gguggaugcucuucaguucga

SEQ ID NO: 1894 - RNA, 21 nt, Artificial Sequence
  source: /note="Description of Artificial Sequence: Synthetic oligonucleotide"
gguggaugcucuucaguucga

SEQ ID NO: 1895 - RNA, 21 nt, Artificial Sequence
  source: /note="Description of Artificial Sequence: Synthetic oligonucleotide"
gcugguggaugcucuucagua

SEQ ID NO: 1896 - RNA, 21 nt, Artificial Sequence
  source: /note="Description of Artificial Sequence: Synthetic oligonucleotide"
gcugguggaugcucuucagua

SEQ ID NO: 1897 - RNA, 21 nt, Artificial Sequence
  source: /note="Description of Artificial Sequence: Synthetic oligonucleotide"
cugguggaugcucuucaguua

SEQ ID NO: 1898 - RNA, 21 nt, Artificial Sequence
  source: /note="Description of Artificial Sequence: Synthetic oligonucleotide"
cugguggaugcucuucaguua

SEQ ID NO: 1899 - RNA, 21 nt, Artificial Sequence
  source: /note="Description of Artificial Sequence: Synthetic oligonucleotide"
ccaaaaugcacugauguaaaa

SEQ ID NO: 1900 - RNA, 21 nt, Artificial Sequence
  source: /note="Description of Artificial Sequence: Synthetic oligonucleotide"
uccaguugcacuaaauuccua

SEQ ID NO: 1901 - RNA, 21 nt, Artificial Sequence
  source: /note="Description of Artificial Sequence: Synthetic oligonucleotide"
cauucuucaacuaucuuugaa

SEQ ID NO: 1902 - RNA, 21 nt, Artificial Sequence
  source: /note="Description of Artificial Sequence: Synthetic oligonucleotide"
acauuccaacauugucuuuaa

SEQ ID NO: 1903 - RNA, 21 nt, Artificial Sequence
  source: /note="Description of Artificial Sequence: Synthetic oligonucleotide"
ggcuuagaauaaaagauguaa

SEQ ID NO: 1904 - RNA, 21 nt, Artificial Sequence
  source: /note="Description of Artificial Sequence: Synthetic oligonucleotide"
uuucaagauauuuguaaaaga

SEQ ID NO: 1905 - RNA, 21 nt, Artificial Sequence
  source: /note="Description of Artificial Sequence: Synthetic oligonucleotide"
auaagcauauuuugaaaauga

SEQ ID NO: 1906 - RNA, 21 nt, Artificial Sequence
  source: /note="Description of Artificial Sequence: Synthetic oligonucleotide"
guuuucaaugcuaguguuuaa

SEQ ID NO: 1907 - RNA, 21 nt, Artificial Sequence
  source: /note="Description of Artificial Sequence: Synthetic oligonucleotide"
caaugaaauacacaaguaaaa

SEQ ID NO: 1908 - RNA, 21 nt, Artificial Sequence
  source: /note="Description of Artificial Sequence: Synthetic oligonucleotide"
caaaaguccacugaugcaaaa

SEQ ID NO: 1909 - RNA, 21 nt, Artificial Sequence
  source: /note="Description of Artificial Sequence: Synthetic oligonucleotide"
aacauagaaaguuucuucaaa

SEQ ID NO: 1910 - RNA, 21 nt, Artificial Sequence
  source: /note="Description of Artificial Sequence: Synthetic oligonucleotide"
aaccuaauuaguaacuuucca

SEQ ID NO: 1911 - RNA, 21 nt, Artificial Sequence
  source: /note="Description of Artificial Sequence: Synthetic oligonucleotide"
gacuuauuuccuucacuuaaa

SEQ ID NO: 1912 - RNA, 21 nt, Artificial Sequence
  source: /note="Description of Artificial Sequence: Synthetic oligonucleotide"
ggcucucaaacuuagcaaaaa

SEQ ID NO: 1913 - RNA, 21 nt, Artificial Sequence
  source: /note="Description of Artificial Sequence: Synthetic oligonucleotide"
acaaagauaagugaaaagaga

SEQ ID NO: 1914 - RNA, 21 nt, Artificial Sequence
  source: /note="Description of Artificial Sequence: Synthetic oligonucleotide"
guaguguacuguucaccaaaa

SEQ ID NO: 1915 - RNA, 21 nt, Artificial Sequence
  source: /note="Description of Artificial Sequence: Synthetic oligonucleotide"
ucaccaacucauagcaaagua

SEQ ID NO: 1916 - RNA, 21 nt, Artificial Sequence
  source: /note="Description of Artificial Sequence: Synthetic oligonucleotide"
aaaauaacucauuauaccaaa

SEQ ID NO: 1917 - RNA, 21 nt, Artificial Sequence
  source: /note="Description of Artificial Sequence: Synthetic oligonucleotide"
aagaaagaaucuuuccauuca

SEQ ID NO: 1918 - RNA, 21 nt, Artificial Sequence
  source: /note="Description of Artificial Sequence: Synthetic oligonucleotide"
auuucaagauauuuguaaaaa

SEQ ID NO: 1919 - RNA, 21 nt, Artificial Sequence
  source: /note="Description of Artificial Sequence: Synthetic oligonucleotide"
agcugaaacucuagaauuaaa

SEQ ID NO: 1920 - RNA, 21 nt, Artificial Sequence
  source: /note="Description of Artificial Sequence: Synthetic oligonucleotide"
aaagauaaaucugauuuauga

SEQ ID NO: 1921 - RNA, 21 nt, Artificial Sequence
  source: /note="Description of Artificial Sequence: Synthetic oligonucleotide"
uauuaaauuaauucugauuga

SEQ ID NO: 1922 - RNA, 21 nt, Artificial Sequence
  source: /note="Description of Artificial Sequence: Synthetic oligonucleotide"
aagaaugagcuuucaacucaa

SEQ ID NO: 1923 - RNA, 21 nt, Artificial Sequence
  source: /note="Description of Artificial Sequence: Synthetic oligonucleotide"
guuugauaacauuuaaaagaa

SEQ ID NO: 1924 - RNA, 21 nt, Artificial Sequence
  source: /note="Description of Artificial Sequence: Synthetic oligonucleotide"
uguuuuaaacauagaaaguua

SEQ ID NO: 1925 - RNA, 21 nt, Artificial Sequence
  source: /note="Description of Artificial Sequence: Synthetic oligonucleotide"
uaaauaacccauucauagcaa

SEQ ID NO: 1926 - RNA, 21 nt, Artificial Sequence
  source: /note="Description of Artificial Sequence: Synthetic oligonucleotide"
cacauagacucuuuaaaacua

SEQ ID NO: 1927 - RNA, 21 nt, Artificial Sequence
  source: /note="Description of Artificial Sequence: Synthetic oligonucleotide"
aagucacaaaguuaucuucua

SEQ ID NO: 1928 - RNA, 21 nt, Artificial Sequence
  source: /note="Description of Artificial Sequence: Synthetic oligonucleotide"
uaaagaaagaauuuaugagaa

SEQ ID NO: 1929 - RNA, 21 nt, Artificial Sequence
  source: /note="Description of Artificial Sequence: Synthetic oligonucleotide"
gaaauguauguuugacuugua

SEQ ID NO: 1930 - RNA, 21 nt, Artificial Sequence
  source: /note="Description of Artificial Sequence: Synthetic oligonucleotide"
uuuauaagaccuuccuguuaa

SEQ ID NO: 1931 - RNA, 21 nt, Artificial Sequence
  source: /note="Description of Artificial Sequence: Synthetic oligonucleotide"
cugugaauguguuuuauccaa

SEQ ID NO: 1932 - RNA, 21 nt, Artificial Sequence
  source: /note="Description of Artificial Sequence: Synthetic oligonucleotide"
uuaauucugauuguauuugaa

SEQ ID NO: 1933 - RNA, 21 nt, Artificial Sequence
  source: /note="Description of Artificial Sequence: Synthetic oligonucleotide"
ugucaucuaccuaccucaaaa

SEQ ID NO: 1934 - RNA, 21 nt, Artificial Sequence
  source: /note="Description of Artificial Sequence: Synthetic oligonucleotide"
cgugaaagcaaaacaauagga

SEQ ID NO: 1935 - RNA, 21 nt, Artificial Sequence
  source: /note="Description of Artificial Sequence: Synthetic oligonucleotide"
aacaacaauucuauagauaga

SEQ ID NO: 1936 - RNA, 21 nt, Artificial Sequence
  source: /note="Description of Artificial Sequence: Synthetic oligonucleotide"
uaaaguauuauuugaacuuua

SEQ ID NO: 1937 - RNA, 21 nt, Artificial Sequence
  source: /note="Description of Artificial Sequence: Synthetic oligonucleotide"
agaaagaauuuaugagaaaua

SEQ ID NO: 1938 - RNA, 21 nt, Artificial Sequence
  source: /note="Description of Artificial Sequence: Synthetic oligonucleotide"
aaaugcacugauguaaaguaa

SEQ ID NO: 1939 - RNA, 21 nt, Artificial Sequence
  source: /note="Description of Artificial Sequence: Synthetic oligonucleotide"
auuaauucugauuguauuuga

SEQ ID NO: 1940 - RNA, 21 nt, Artificial Sequence
  source: /note="Description of Artificial Sequence: Synthetic oligonucleotide"
caauaauguucuauagaaaaa

SEQ ID NO: 1941 - RNA, 21 nt, Artificial Sequence
  source: /note="Description of Artificial Sequence: Synthetic oligonucleotide"
gauuuucaauuugauuuugaa

SEQ ID NO: 1942 - RNA, 21 nt, Artificial Sequence
  source: /note="Description of Artificial Sequence: Synthetic oligonucleotide"
uugauuuugaauucugcauua

SEQ ID NO: 1943 - RNA, 21 nt, Artificial Sequence
  source: /note="Description of Artificial Sequence: Synthetic oligonucleotide"
uuucaauuugauuuugaauua

SEQ ID NO: 1944 - RNA, 21 nt, Artificial Sequence
  source: /note="Description of Artificial Sequence: Synthetic oligonucleotide"
gugucuguguaucaugaaaaa

SEQ ID NO: 1945 - RNA, 21 nt, Artificial Sequence
  source: /note="Description of Artificial Sequence: Synthetic oligonucleotide"
gguuuuaugaauacaaagaua

SEQ ID NO: 1946 - RNA, 21 nt, Artificial Sequence
  source: /note="Description of Artificial Sequence: Synthetic oligonucleotide"
gcagaucaagauuuucucaua

SEQ ID NO: 1947 - RNA, 21 nt, Artificial Sequence
  source: /note="Description of Artificial Sequence: Synthetic oligonucleotide"
aacuaauugaaucauuaucua

SEQ ID NO: 1948 - RNA, 21 nt, Artificial Sequence
  source: /note="Description of Artificial Sequence: Synthetic oligonucleotide"
ugguuuaugaauuguuuccua

SEQ ID NO: 1949 - RNA, 21 nt, Artificial Sequence
  source: /note="Description of Artificial Sequence: Synthetic oligonucleotide"
uaguauaauggugcuauuuua

SEQ ID NO: 1950 - RNA, 21 nt, Artificial Sequence
  source: /note="Description of Artificial Sequence: Synthetic oligonucleotide"
cuguuuaauaagcauauuuua

SEQ ID NO: 1951 - RNA, 21 nt, Artificial Sequence
  source: /note="Description of Artificial Sequence: Synthetic oligonucleotide"
aaauaucaaaaccuuucaaaa

SEQ ID NO: 1952 - RNA, 21 nt, Artificial Sequence
  source: /note="Description of Artificial Sequence: Synthetic oligonucleotide"
acagauguaaaagaaacuaua

SEQ ID NO: 1953 - RNA, 21 nt, Artificial Sequence
  source: /note="Description of Artificial Sequence: Synthetic oligonucleotide"
aacuuugaggccaaucauuua

SEQ ID NO: 1954 - RNA, 23 nt, Artificial Sequence
  source: /note="Description of Artificial Sequence: Synthetic oligonucleotide"
uaugauucaauuaguuacauuuu

SEQ ID NO: 1955 - RNA, 23 nt, Artificial Sequence
  source: /note="Description of Artificial Sequence: Synthetic oligonucleotide"
uuuuagucaaguacuuucuuaaa

SEQ ID NO: 1956 - RNA, 23 nt, Artificial Sequence
  source: /note="Description of Artificial Sequence: Synthetic oligonucleotide"
ucucauucaagaauuauaaagca

SEQ ID NO: 1957 - RNA, 23 nt, Artificial Sequence
  source: /note="Description of Artificial Sequence: Synthetic oligonucleotide"
uucaaacauacauuucuaucuag

SEQ ID NO: 1958 - RNA, 23 nt, Artificial Sequence
  source: /note="Description of Artificial Sequence: Synthetic oligonucleotide"
uagauucuaaggauuguggaagg

SEQ ID NO: 1959 - RNA, 23 nt, Artificial Sequence
  source: /note="Description of Artificial Sequence: Synthetic oligonucleotide"
uauauuugaaagguuuugauauu

SEQ ID NO: 1960 - RNA, 23 nt, Artificial Sequence
  source: /note="Description of Artificial Sequence: Synthetic oligonucleotide"
uauguuggaauguuuacuugugu

SEQ ID NO: 1961 - RNA, 23 nt, Artificial Sequence
  source: /note="Description of Artificial Sequence: Synthetic oligonucleotide"
uguugaagaaacuuucuauguuu

SEQ ID NO: 1962 - RNA, 23 nt, Artificial Sequence
  source: /note="Description of Artificial Sequence: Synthetic oligonucleotide"
uguuaaaauacuuguugacugaa

SEQ ID NO: 1963 - RNA, 23 nt, Artificial Sequence
  source: /note="Description of Artificial Sequence: Synthetic oligonucleotide"
uauguaaguagacagcuugaggu

SEQ ID NO: 1964 - RNA, 23 nt, Artificial Sequence
  source: /note="Description of Artificial Sequence: Synthetic oligonucleotide"
uugcaaauaaggaaacaauucau

SEQ ID NO: 1965 - RNA, 23 nt, Artificial Sequence
  source: /note="Description of Artificial Sequence: Synthetic oligonucleotide"
ugcuuuucaacuaagacagaugu

SEQ ID NO: 1966 - RNA, 23 nt, Artificial Sequence
  source: /note="Description of Artificial Sequence: Synthetic oligonucleotide"
uuggauaauauauugcuaauuuu

SEQ ID NO: 1967 - RNA, 23 nt, Artificial Sequence
  source: /note="Description of Artificial Sequence: Synthetic oligonucleotide"
uuguaagauaaugauucaauuag

SEQ ID NO: 1968 - RNA, 23 nt, Artificial Sequence
  source: /note="Description of Artificial Sequence: Synthetic oligonucleotide"
uuauagaacauuauugauaaaag

SEQ ID NO: 1969 - RNA, 23 nt, Artificial Sequence
  source: /note="Description of Artificial Sequence: Synthetic oligonucleotide"
uugauguauaguuucuuuuacau

SEQ ID NO: 1970 - RNA, 23 nt, Artificial Sequence
  source: /note="Description of Artificial Sequence: Synthetic oligonucleotide"
uuuaacuuauuauuccucauucu

SEQ ID NO: 1971 - RNA, 23 nt, Artificial Sequence
  source: /note="Description of Artificial Sequence: Synthetic oligonucleotide"
ugauaaaacacauucacagagag

SEQ ID NO: 1972 - RNA, 23 nt, Artificial Sequence
  source: /note="Description of Artificial Sequence: Synthetic oligonucleotide"
uaacucaucauuugaaggaacuc

SEQ ID NO: 1973 - RNA, 23 nt, Artificial Sequence
  source: /note="Description of Artificial Sequence: Synthetic oligonucleotide"
uaaauugauaucuuuauccugua

SEQ ID NO: 1974 - RNA, 23 nt, Artificial Sequence
  source: /note="Description of Artificial Sequence: Synthetic oligonucleotide"
uagagaugcgaggaggacauggu

SEQ ID NO: 1975 - RNA, 23 nt, Artificial Sequence
  source: /note="Description of Artificial Sequence: Synthetic oligonucleotide"
uagagaugcgaggaggacauggu

SEQ ID NO: 1976 - RNA, 23 nt, Artificial Sequence
  source: /note="Description of Artificial Sequence: Synthetic oligonucleotide"
uuacccugugggcuuguugaaau

SEQ ID NO: 1977 - RNA, 23 nt, Artificial Sequence
  source: /note="Description of Artificial Sequence: Synthetic oligonucleotide"
uuacccugugggcuuguugaaau

SEQ ID NO: 1978 - RNA, 23 nt, Artificial Sequence
  source: /note="Description of Artificial Sequence: Synthetic oligonucleotide"
uagguagaagagaugcgaggagg

SEQ ID NO: 1979 - RNA, 23 nt, Artificial Sequence
  source: /note="Description of Artificial Sequence: Synthetic oligonucleotide"
uagguagaagagaugcgaggagg

SEQ ID NO: 1980 - RNA, 23 nt, Artificial Sequence
  source: /note="Description of Artificial Sequence: Synthetic oligonucleotide"
ucuuguugaaauaaaagccccug

SEQ ID NO: 1981 - RNA, 23 nt, Artificial Sequence
  source: /note="Description of Artificial Sequence: Synthetic oligonucleotide"
ucuuguugaaauaaaagccccug

SEQ ID NO: 1982 - RNA, 23 nt, Artificial Sequence
  source: /note="Description of Artificial Sequence: Synthetic oligonucleotide"
ucacacgaacugaagagcaucca

SEQ ID NO: 1983 - RNA, 23 nt, Artificial Sequence
  source: /note="Description of Artificial Sequence: Synthetic oligonucleotide"
ucacacgaacugaagagcaucca

SEQ ID NO: 1984 - RNA, 23 nt, Artificial Sequence
  source: /note="Description of Artificial Sequence: Synthetic oligonucleotide"
ucacgaacugaagagcauccacc

SEQ ID NO: 1985 - RNA, 23 nt, Artificial Sequence
  source: /note="Description of Artificial Sequence: Synthetic oligonucleotide"
ucacgaacugaagagcauccacc

SEQ ID NO: 1986 - RNA, 23 nt, Artificial Sequence
  source: /note="Description of Artificial Sequence: Synthetic oligonucleotide"
ucgaacugaagagcauccaccag

SEQ ID NO: 1987 - RNA, 23 nt, Artificial Sequence
  source: /note="Description of Artificial Sequence: Synthetic oligonucleotide"
ucgaacugaagagcauccaccag

SEQ ID NO: 1988 - RNA, 23 nt, Artificial Sequence
  source: /note="Description of Artificial Sequence: Synthetic oligonucleotide"
uacugaagagcauccaccagcuc

SEQ ID NO: 1989 - RNA, 23 nt, Artificial Sequence
  source: /note="Description of Artificial Sequence: Synthetic oligonucleotide"
uacugaagagcauccaccagcuc

SEQ ID NO: 1990 - RNA, 23 nt, Artificial Sequence
  source: /note="Description of Artificial Sequence: Synthetic oligonucleotide"
uaacugaagagcauccaccagcu

SEQ ID NO: 1991 - RNA, 23 nt, Artificial Sequence
  source: /note="Description of Artificial Sequence: Synthetic oligonucleotide"
uaacugaagagcauccaccagcu

SEQ ID NO: 1992 - RNA, 23 nt, Artificial Sequence
  source: /note="Description of Artificial Sequence: Synthetic oligonucleotide"
uuuuacaucagugcauuuugggc

SEQ ID NO: 1993 - RNA, 23 nt, Artificial Sequence
  source: /note="Description of Artificial Sequence: Synthetic oligonucleotide"
uaggaauuuagugcaacuggauc

SEQ ID NO: 1994 - RNA, 23 nt, Artificial Sequence
  source: /note="Description of Artificial Sequence: Synthetic oligonucleotide"
uucaaagauaguugaagaaugag

SEQ ID NO: 1995 - RNA, 23 nt, Artificial Sequence
  source: /note="Description of Artificial Sequence: Synthetic oligonucleotide"
uuaaagacaauguuggaauguuu

SEQ ID NO: 1996 - RNA, 23 nt, Artificial Sequence
  source: /note="Description of Artificial Sequence: Synthetic oligonucleotide"
uuacaucuuuuauucuaagccuu

SEQ ID NO: 1997 - RNA, 23 nt, Artificial Sequence
  source: /note="Description of Artificial Sequence: Synthetic oligonucleotide"
ucuuuuacaaauaucuugaaauu

SEQ ID NO: 1998 - RNA, 23 nt, Artificial Sequence
  source: /note="Description of Artificial Sequence: Synthetic oligonucleotide"
ucauuuucaaaauaugcuuauua

SEQ ID NO: 1999 - RNA, 23 nt, Artificial Sequence
  source: /note="Description of Artificial Sequence: Synthetic oligonucleotide"
uuaaacacuagcauugaaaacaa

SEQ ID NO: 2000 - RNA, 23 nt, Artificial Sequence
  source: /note="Description of Artificial Sequence: Synthetic oligonucleotide"
uuuuacuuguguauuucauuggg

SEQ ID NO: 2001 - RNA, 23 nt, Artificial Sequence
  source: /note="Description of Artificial Sequence: Synthetic oligonucleotide"
uuuugcaucaguggacuuuugug

SEQ ID NO: 2002 - RNA, 23 nt, Artificial Sequence
  source: /note="Description of Artificial Sequence: Synthetic oligonucleotide"
uuugaagaaacuuucuauguuua

SEQ ID NO: 2003 - RNA, 23 nt, Artificial Sequence
  source: /note="Description of Artificial Sequence: Synthetic oligonucleotide"
uggaaaguuacuaauuagguugc

SEQ ID NO: 2004 - RNA, 23 nt, Artificial Sequence
  source: /note="Description of Artificial Sequence: Synthetic oligonucleotide"
uuuaagugaaggaaauaagucau

SEQ ID NO: 2005 - RNA, 23 nt, Artificial Sequence
  source: /note="Description of Artificial Sequence: Synthetic oligonucleotide"
uuuuugcuaaguuugagagccaa

SEQ ID NO: 2006 - RNA, 23 nt, Artificial Sequence
  source: /note="Description of Artificial Sequence: Synthetic oligonucleotide"
ucucuuuucacuuaucuuuguau

SEQ ID NO: 2007 - RNA, 23 nt, Artificial Sequence
  source: /note="Description of Artificial Sequence: Synthetic oligonucleotide"
uuuuggugaacaguacacuacuu

SEQ ID NO: 2008 - RNA, 23 nt, Artificial Sequence
  source: /note="Description of Artificial Sequence: Synthetic oligonucleotide"
uacuuugcuaugaguuggugagu

SEQ ID NO: 2009 - RNA, 23 nt, Artificial Sequence
  source: /note="Description of Artificial Sequence: Synthetic oligonucleotide"
uuugguauaaugaguuauuuuca

SEQ ID NO: 2010 - RNA, 23 nt, Artificial Sequence
  source: /note="Description of Artificial Sequence: Synthetic oligonucleotide"
ugaauggaaagauucuuucuucu

SEQ ID NO: 2011 - RNA, 23 nt, Artificial Sequence
  source: /note="Description of Artificial Sequence: Synthetic oligonucleotide"
uuuuuacaaauaucuugaaauug

SEQ ID NO: 2012 - RNA, 23 nt, Artificial Sequence
  source: /note="Description of Artificial Sequence: Synthetic oligonucleotide"
uuuaauucuagaguuucagcuug

SEQ ID NO: 2013 - RNA, 23 nt, Artificial Sequence
  source: /note="Description of Artificial Sequence: Synthetic oligonucleotide"
ucauaaaucagauuuaucuuuug

SEQ ID NO: 2014 - RNA, 23 nt, Artificial Sequence
  source: /note="Description of Artificial Sequence: Synthetic oligonucleotide"
ucaaucagaauuaauuuaauaaa

SEQ ID NO: 2015 - RNA, 23 nt, Artificial Sequence
  source: /note="Description of Artificial Sequence: Synthetic oligonucleotide"
uugaguugaaagcucauucuuac

SEQ ID NO: 2016 - RNA, 23 nt, Artificial Sequence
  source: /note="Description of Artificial Sequence: Synthetic oligonucleotide"
uucuuuuaaauguuaucaaacuu

SEQ ID NO: 2017 - RNA, 23 nt, Artificial Sequence
  source: /note="Description of Artificial Sequence: Synthetic oligonucleotide"
uaacuuucuauguuuaaaacaua

SEQ ID NO: 2018 - RNA, 23 nt, Artificial Sequence
  source: /note="Description of Artificial Sequence: Synthetic oligonucleotide"
uugcuaugaauggguuauuuaua

SEQ ID NO: 2019 - RNA, 23 nt, Artificial Sequence
  source: /note="Description of Artificial Sequence: Synthetic oligonucleotide"
uaguuuuaaagagucuauguggg

SEQ ID NO: 2020 - RNA, 23 nt, Artificial Sequence
  source: /note="Description of Artificial Sequence: Synthetic oligonucleotide"
uagaagauaacuuugugacuuuu

SEQ ID NO: 2021 - RNA, 23 nt, Artificial Sequence
  source: /note="Description of Artificial Sequence: Synthetic oligonucleotide"
uucucauaaauucuuucuuuauc

SEQ ID NO: 2022 - RNA, 23 nt, Artificial Sequence
  source: /note="Description of Artificial Sequence: Synthetic oligonucleotide"
uacaagucaaacauacauuucua

SEQ ID NO: 2023 - RNA, 23 nt, Artificial Sequence
  source: /note="Description of Artificial Sequence: Synthetic oligonucleotide"
uuaacaggaaggucuuauaaaau

SEQ ID NO: 2024 - RNA, 23 nt, Artificial Sequence
  source: /note="Description of Artificial Sequence: Synthetic oligonucleotide"
uuggauaaaacacauucacagag

SEQ ID NO: 2025 - RNA, 23 nt, Artificial Sequence
  source: /note="Description of Artificial Sequence: Synthetic oligonucleotide"
uucaaauacaaucagaauuaauu

SEQ ID NO: 2026 - RNA, 23 nt, Artificial Sequence
  source: /note="Description of Artificial Sequence: Synthetic oligonucleotide"
uuuugagguagguagaugacaua

SEQ ID NO: 2027 - RNA, 23 nt, Artificial Sequence
  source: /note="Description of Artificial Sequence: Synthetic oligonucleotide"
uccuauuguuuugcuuucacgua

SEQ ID NO: 2028 - RNA, 23 nt, Artificial Sequence
  source: /note="Description of Artificial Sequence: Synthetic oligonucleotide"
ucuaucuauagaauuguuguuuu

SEQ ID NO: 2029 - RNA, 23 nt, Artificial Sequence
  source: /note="Description of Artificial Sequence: Synthetic oligonucleotide"
uaaaguucaaauaauacuuuaau

SEQ ID NO: 2030 - RNA, 23 nt, Artificial Sequence
  source: /note="Description of Artificial Sequence: Synthetic oligonucleotide"
uauuucucauaaauucuuucuuu

SEQ ID NO: 2031 - RNA, 23 nt, Artificial Sequence
  source: /note="Description of Artificial Sequence: Synthetic oligonucleotide"
uuacuuuacaucagugcauuuug

SEQ ID NO: 2032 - RNA, 23 nt, Artificial Sequence
  source: /note="Description of Artificial Sequence: Synthetic oligonucleotide"
ucaaauacaaucagaauuaauuu

SEQ ID NO: 2033 - RNA, 23 nt, Artificial Sequence
  source: /note="Description of Artificial Sequence: Synthetic oligonucleotide"
uuuuucuauagaacauuauugau

SEQ ID NO: 2034 - RNA, 23 nt, Artificial Sequence
  source: /note="Description of Artificial Sequence: Synthetic oligonucleotide"
uucaaaaucaaauugaaaaucaa

SEQ ID NO: 2035 - RNA, 23 nt, Artificial Sequence
  source: /note="Description of Artificial Sequence: Synthetic oligonucleotide"
uaaugcagaauucaaaaucaaau

SEQ ID NO: 2036 - RNA, 23 nt, Artificial Sequence
  source: /note="Description of Artificial Sequence: Synthetic oligonucleotide"
uaauucaaaaucaaauugaaaau

SEQ ID NO: 2037 - RNA, 23 nt, Artificial Sequence
  source: /note="Description of Artificial Sequence: Synthetic oligonucleotide"
uuuuucaugauacacagacacag

SEQ ID NO: 2038 - RNA, 23 nt, Artificial Sequence
  source: /note="Description of Artificial Sequence: Synthetic oligonucleotide"
uaucuuuguauucauaaaaccaa

SEQ ID NO: 2039 - RNA, 23 nt, Artificial Sequence
  source: /note="Description of Artificial Sequence: Synthetic oligonucleotide"
uaugagaaaaucuugaucugcag

SEQ ID NO: 2040 - RNA, 23 nt, Artificial Sequence
  source: /note="Description of Artificial Sequence: Synthetic oligonucleotide"
uagauaaugauucaauuaguuac

SEQ ID NO: 2041 - RNA, 23 nt, Artificial Sequence
  source: /note="Description of Artificial Sequence: Synthetic oligonucleotide"
uaggaaacaauucauaaaccacu

SEQ ID NO: 2042 - RNA, 23 nt, Artificial Sequence
  source: /note="Description of Artificial Sequence: Synthetic oligonucleotide"
uaaaauagcaccauuauacuaaa

SEQ ID NO: 2043 - RNA, 23 nt, Artificial Sequence
  source: /note="Description of Artificial Sequence: Synthetic oligonucleotide"
uaaaauaugcuuauuaaacagua

SEQ ID NO: 2044 - RNA, 23 nt, Artificial Sequence
  source: /note="Description of Artificial Sequence: Synthetic oligonucleotide"
uuuugaaagguuuugauauuuug

SEQ ID NO: 2045 - RNA, 23 nt, Artificial Sequence
  source: /note="Description of Artificial Sequence: Synthetic oligonucleotide"
uauaguuucuuuuacaucugucc

SEQ ID NO: 2046 - RNA, 23 nt, Artificial Sequence
  source: /note="Description of Artificial Sequence: Synthetic oligonucleotide"
uaaaugauuggccucaaaguugc

SEQ ID NO: 2047 - RNA, 23 nt, Artificial Sequence
  source: /note="Description of Artificial Sequence: Synthetic oligonucleotide"
aaaauguaacuaauugaaucauu

SEQ ID NO: 2048 - RNA, 23 nt, Artificial Sequence
  source: /note="Description of Artificial Sequence: Synthetic oligonucleotide"
uuuaagaaaguacuugacuaaaa

SEQ ID NO: 2049 - RNA, 23 nt, Artificial Sequence
  source: /note="Description of Artificial Sequence: Synthetic oligonucleotide"
ugcuuuauaauucuugaaugagg

SEQ ID NO: 2050 - RNA, 23 nt, Artificial Sequence
  source: /note="Description of Artificial Sequence: Synthetic oligonucleotide"
cuagauagaaauguauguuugac

SEQ ID NO: 2051 - RNA, 23 nt, Artificial Sequence
  source: /note="Description of Artificial Sequence: Synthetic oligonucleotide"
ccuuccacaauccuuagaaucug

SEQ ID NO: 2052 - RNA, 23 nt, Artificial Sequence
  source: /note="Description of Artificial Sequence: Synthetic oligonucleotide"
aauaucaaaaccuuucaaauauc

SEQ ID NO: 2053 - RNA, 23 nt, Artificial Sequence
  source: /note="Description of Artificial Sequence: Synthetic oligonucleotide"
acacaaguaaacauuccaacauu

SEQ ID NO: 2054 - RNA, 23 nt, Artificial Sequence
  source: /note="Description of Artificial Sequence: Synthetic oligonucleotide"
aaacauagaaaguuucuucaacu

SEQ ID NO: 2055 - RNA, 23 nt, Artificial Sequence
  source: /note="Description of Artificial Sequence: Synthetic oligonucleotide"
uucagucaacaaguauuuuaacu

SEQ ID NO: 2056 - RNA, 23 nt, Artificial Sequence
  source: /note="Description of Artificial Sequence: Synthetic oligonucleotide"
accucaagcugucuacuuacauc

SEQ ID NO: 2057 - RNA, 23 nt, Artificial Sequence
  source: /note="Description of Artificial Sequence: Synthetic oligonucleotide"
augaauuguuuccuuauuugcac

SEQ ID NO: 2058 - RNA, 23 nt, Artificial Sequence
  source: /note="Description of Artificial Sequence: Synthetic oligonucleotide"
acaucugucuuaguugaaaagca

SEQ ID NO: 2059 - RNA, 23 nt, Artificial Sequence
  source: /note="Description of Artificial Sequence: Synthetic oligonucleotide"
aaaauuagcaauauauuauccaa

SEQ ID NO: 2060 - RNA, 23 nt, Artificial Sequence
  source: /note="Description of Artificial Sequence: Synthetic oligonucleotide"
cuaauugaaucauuaucuuacau

SEQ ID NO: 2061 - RNA, 23 nt, Artificial Sequence
  source: /note="Description of Artificial Sequence: Synthetic oligonucleotide"
cuuuuaucaauaauguucuauag

SEQ ID NO: 2062 - RNA, 23 nt, Artificial Sequence
  source: /note="Description of Artificial Sequence: Synthetic oligonucleotide"
auguaaaagaaacuauacaucau

SEQ ID NO: 2063 - RNA, 23 nt, Artificial Sequence
  source: /note="Description of Artificial Sequence: Synthetic oligonucleotide"
agaaugaggaauaauaaguuaaa

SEQ ID NO: 2064 - RNA, 23 nt, Artificial Sequence
  source: /note="Description of Artificial Sequence: Synthetic oligonucleotide"
cucucugugaauguguuuuaucc

SEQ ID NO: 2065 - RNA, 23 nt, Artificial Sequence
  source: /note="Description of Artificial Sequence: Synthetic oligonucleotide"
gaguuccuucaaaugaugaguua

SEQ ID NO: 2066 - RNA, 23 nt, Artificial Sequence
  source: /note="Description of Artificial Sequence: Synthetic oligonucleotide"
uacaggauaaagauaucaauuua

SEQ ID NO: 2067 - RNA, 23 nt, Artificial Sequence
  source: /note="Description of Artificial Sequence: Synthetic oligonucleotide"
accauguccuccucgcaucucuu

SEQ ID NO: 2068 - RNA, 23 nt, Artificial Sequence
  source: /note="Description of Artificial Sequence: Synthetic oligonucleotide"
accauguccuccucgcaucucuu

SEQ ID NO: 2069 - RNA, 23 nt, Artificial Sequence
  source: /note="Description of Artificial Sequence: Synthetic oligonucleotide"
auuucaacaagcccacaggguau

SEQ ID NO: 2070 - RNA, 23 nt, Artificial Sequence
  source: /note="Description of Artificial Sequence: Synthetic oligonucleotide"
auuucaacaagcccacaggguau

SEQ ID NO: 2071 - RNA, 23 nt, Artificial Sequence
  source: /note="Description of Artificial Sequence: Synthetic oligonucleotide"
ccuccucgcaucucuucuaccug

SEQ ID NO: 2072 - RNA, 23 nt, Artificial Sequence
  source: /note="Description of Artificial Sequence: Synthetic oligonucleotide"
ccuccucgcaucucuucuaccug

SEQ ID NO: 2073 - RNA, 23 nt, Artificial Sequence
  source: /note="Description of Artificial Sequence: Synthetic oligonucleotide"
caggggcuuuuauuucaacaagc

SEQ ID NO: 2074 - RNA, 23 nt, Artificial Sequence
  source: /note="Description of Artificial Sequence: Synthetic oligonucleotide"
caggggcuuuuauuucaacaagc

SEQ ID NO: 2075 - RNA, 23 nt, Artificial Sequence
  source: /note="Description of Artificial Sequence: Synthetic oligonucleotide"
uggaugcucuucaguucgugugu

SEQ ID NO: 2076 - RNA, 23 nt, Artificial Sequence
  source: /note="Description of Artificial Sequence: Synthetic oligonucleotide"
uggaugcucuucaguucgugugu

SEQ ID NO: 2077 - RNA, 23 nt, Artificial Sequence
  source: /note="Description of Artificial Sequence: Synthetic oligonucleotide"
gguggaugcucuucaguucgugu

SEQ ID NO: 2078 - RNA, 23 nt, Artificial Sequence
  source: /note="Description of Artificial Sequence: Synthetic oligonucleotide"
gguggaugcucuucaguucgugu

SEQ ID NO: 2079 - RNA, 23 nt, Artificial Sequence
  source: /note="Description of Artificial Sequence: Synthetic oligonucleotide"
cugguggaugcucuucaguucgu

SEQ ID NO: 2080 - RNA, 23 nt, Artificial Sequence
  source: /note="Description of Artificial Sequence: Synthetic oligonucleotide"
cugguggaugcucuucaguucgu

SEQ ID NO: 2081 - RNA, 23 nt, Artificial Sequence
  source: /note="Description of Artificial Sequence: Synthetic oligonucleotide"
gagcugguggaugcucuucaguu

SEQ ID NO: 2082 - RNA, 23 nt, Artificial Sequence
  source: /note="Description of Artificial Sequence: Synthetic oligonucleotide"
gagcugguggaugcucuucaguu

SEQ ID NO: 2083 - RNA, 23 nt, Artificial Sequence
  source: /note="Description of Artificial Sequence: Synthetic oligonucleotide"
agcugguggaugcucuucaguuc

SEQ ID NO: 2084 - RNA, 23 nt, Artificial Sequence
  source: /note="Description of Artificial Sequence: Synthetic oligonucleotide"
agcugguggaugcucuucaguuc

SEQ ID NO: 2085 - RNA, 23 nt, Artificial Sequence
  source: /note="Description of Artificial Sequence: Synthetic oligonucleotide"
gcccaaaaugcacugauguaaag

SEQ ID NO: 2086 - RNA, 23 nt, Artificial Sequence
  source: /note="Description of Artificial Sequence: Synthetic oligonucleotide"
gauccaguugcacuaaauuccuc

SEQ ID NO: 2087 - RNA, 23 nt, Artificial Sequence
  source: /note="Description of Artificial Sequence: Synthetic oligonucleotide"
cucauucuucaacuaucuuugau

SEQ ID NO: 2088 - RNA, 23 nt, Artificial Sequence
  source: /note="Description of Artificial Sequence: Synthetic oligonucleotide"
aaacauuccaacauugucuuuag

SEQ ID NO: 2089 - RNA, 23 nt, Artificial Sequence
  source: /note="Description of Artificial Sequence: Synthetic oligonucleotide"
aaggcuuagaauaaaagauguag

SEQ ID NO: 2090 - RNA, 23 nt, Artificial Sequence
  source: /note="Description of Artificial Sequence: Synthetic oligonucleotide"
aauuucaagauauuuguaaaaga

SEQ ID NO: 2091 - RNA, 23 nt, Artificial Sequence
  source: /note="Description of Artificial Sequence: Synthetic oligonucleotide"
uaauaagcauauuuugaaaaugu

SEQ ID NO: 2092 - RNA, 23 nt, Artificial Sequence
  source: /note="Description of Artificial Sequence: Synthetic oligonucleotide"
uuguuuucaaugcuaguguuuaa

SEQ ID NO: 2093 - RNA, 23 nt, Artificial Sequence
  source: /note="Description of Artificial Sequence: Synthetic oligonucleotide"
cccaaugaaauacacaaguaaac

SEQ ID NO: 2094 - RNA, 23 nt, Artificial Sequence
  source: /note="Description of Artificial Sequence: Synthetic oligonucleotide"
cacaaaaguccacugaugcaaau

SEQ ID NO: 2095 - RNA, 23 nt, Artificial Sequence
  source: /note="Description of Artificial Sequence: Synthetic oligonucleotide"
uaaacauagaaaguuucuucaac

SEQ ID NO: 2096 - RNA, 23 nt, Artificial Sequence
  source: /note="Description of Artificial Sequence: Synthetic oligonucleotide"
gcaaccuaauuaguaacuuuccu

SEQ ID NO: 2097 - RNA, 23 nt, Artificial Sequence
  source: /note="Description of Artificial Sequence: Synthetic oligonucleotide"
augacuuauuuccuucacuuaau

SEQ ID NO: 2098 - RNA, 23 nt, Artificial Sequence
  source: /note="Description of Artificial Sequence: Synthetic oligonucleotide"
uuggcucucaaacuuagcaaaau

SEQ ID NO: 2099 - RNA, 23 nt, Artificial Sequence
  source: /note="Description of Artificial Sequence: Synthetic oligonucleotide"
auacaaagauaagugaaaagaga

SEQ ID NO: 2100 - RNA, 23 nt, Artificial Sequence
  source: /note="Description of Artificial Sequence: Synthetic oligonucleotide"
aaguaguguacuguucaccaaau

SEQ ID NO: 2101 - RNA, 23 nt, Artificial Sequence
  source: /note="Description of Artificial Sequence: Synthetic oligonucleotide"
acucaccaacucauagcaaaguc

SEQ ID NO: 2102 - RNA, 23 nt, Artificial Sequence
  source: /note="Description of Artificial Sequence: Synthetic oligonucleotide"
ugaaaauaacucauuauaccaau

SEQ ID NO: 2103 - RNA, 23 nt, Artificial Sequence
  source: /note="Description of Artificial Sequence: Synthetic oligonucleotide"
agaagaaagaaucuuuccauuca

SEQ ID NO: 2104 - RNA, 23 nt, Artificial Sequence
  source: /note="Description of Artificial Sequence: Synthetic oligonucleotide"
caauuucaagauauuuguaaaag

SEQ ID NO: 2105 - RNA, 23 nt, Artificial Sequence
  source: /note="Description of Artificial Sequence: Synthetic oligonucleotide"
caagcugaaacucuagaauuaaa

SEQ ID NO: 2106 - RNA, 23 nt, Artificial Sequence
  source: /note="Description of Artificial Sequence: Synthetic oligonucleotide"
caaaagauaaaucugauuuaugc

SEQ ID NO: 2107 - RNA, 23 nt, Artificial Sequence
  source: /note="Description of Artificial Sequence: Synthetic oligonucleotide"
uuuauuaaauuaauucugauugu

SEQ ID NO: 2108 - RNA, 23 nt, Artificial Sequence
  source: /note="Description of Artificial Sequence: Synthetic oligonucleotide"
guaagaaugagcuuucaacucau

SEQ ID NO: 2109 - RNA, 23 nt, Artificial Sequence
  source: /note="Description of Artificial Sequence: Synthetic oligonucleotide"
aaguuugauaacauuuaaaagau

SEQ ID NO: 2110 - RNA, 23 nt, Artificial Sequence
  source: /note="Description of Artificial Sequence: Synthetic oligonucleotide"
uauguuuuaaacauagaaaguuu

SEQ ID NO: 2111 - RNA, 23 nt, Artificial Sequence
  source: /note="Description of Artificial Sequence: Synthetic oligonucleotide"
uauaaauaacccauucauagcau

SEQ ID NO: 2112 - RNA, 23 nt, Artificial Sequence
  source: /note="Description of Artificial Sequence: Synthetic oligonucleotide"
cccacauagacucuuuaaaacua

SEQ ID NO: 2113 - RNA, 23 nt, Artificial Sequence
  source: /note="Description of Artificial Sequence: Synthetic oligonucleotide"
aaaagucacaaaguuaucuucuu

SEQ ID NO: 2114 - RNA, 23 nt, Artificial Sequence
  source: /note="Description of Artificial Sequence: Synthetic oligonucleotide"
gauaaagaaagaauuuaugagaa

SEQ ID NO: 2115 - RNA, 23 nt, Artificial Sequence
  source: /note="Description of Artificial Sequence: Synthetic oligonucleotide"
uagaaauguauguuugacuuguu

SEQ ID NO: 2116 - RNA, 23 nt, Artificial Sequence
  source: /note="Description of Artificial Sequence: Synthetic oligonucleotide"
auuuuauaagaccuuccuguuag

SEQ ID NO: 2117 - RNA, 23 nt, Artificial Sequence
  source: /note="Description of Artificial Sequence: Synthetic oligonucleotide"
cucugugaauguguuuuauccau

SEQ ID NO: 2118 - RNA, 23 nt, Artificial Sequence
  source: /note="Description of Artificial Sequence: Synthetic oligonucleotide"
aauuaauucugauuguauuugaa

SEQ ID NO: 2119 - RNA, 23 nt, Artificial Sequence
  source: /note="Description of Artificial Sequence: Synthetic oligonucleotide"
uaugucaucuaccuaccucaaag

SEQ ID NO: 2120 - RNA, 23 nt, Artificial Sequence
  source: /note="Description of Artificial Sequence: Synthetic oligonucleotide"
uacgugaaagcaaaacaauaggg

SEQ ID NO: 2121 - RNA, 23 nt, Artificial Sequence
  source: /note="Description of Artificial Sequence: Synthetic oligonucleotide"
aaaacaacaauucuauagauaga

SEQ ID NO: 2122 - RNA, 23 nt, Artificial Sequence
  source: /note="Description of Artificial Sequence: Synthetic oligonucleotide"
auuaaaguauuauuugaacuuuu

SEQ ID NO: 2123 - RNA, 23 nt, Artificial Sequence
  source: /note="Description of Artificial Sequence: Synthetic oligonucleotide"
aaagaaagaauuuaugagaaauu

SEQ ID NO: 2124 - RNA, 23 nt, Artificial Sequence
  source: /note="Description of Artificial Sequence: Synthetic oligonucleotide"
caaaaugcacugauguaaaguag

SEQ ID NO: 2125 - RNA, 23 nt, Artificial Sequence
  source: /note="Description of Artificial Sequence: Synthetic oligonucleotide"
aaauuaauucugauuguauuuga

SEQ ID NO: 2126 - RNA, 23 nt, Artificial Sequence
  source: /note="Description of Artificial Sequence: Synthetic oligonucleotide"
aucaauaauguucuauagaaaag

SEQ ID NO: 2127 - RNA, 23 nt, Artificial Sequence
  source: /note="Description of Artificial Sequence: Synthetic oligonucleotide"
uugauuuucaauuugauuuugaa

SEQ ID NO: 2128 - RNA, 23 nt, Artificial Sequence
  source: /note="Description of Artificial Sequence: Synthetic oligonucleotide"
auuugauuuugaauucugcauuu

SEQ ID NO: 2129 - RNA, 23 nt, Artificial Sequence
  source: /note="Description of Artificial Sequence: Synthetic oligonucleotide"
auuuucaauuugauuuugaauuc

SEQ ID NO: 2130 - RNA, 23 nt, Artificial Sequence
  source: /note="Description of Artificial Sequence: Synthetic oligonucleotide"
cugugucuguguaucaugaaaau

SEQ ID NO: 2131 - RNA, 23 nt, Artificial Sequence
  source: /note="Description of Artificial Sequence: Synthetic oligonucleotide"
uugguuuuaugaauacaaagaua

SEQ ID NO: 2132 - RNA, 23 nt, Artificial Sequence
  source: /note="Description of Artificial Sequence: Synthetic oligonucleotide"
cugcagaucaagauuuucucauu

SEQ ID NO: 2133 - RNA, 23 nt, Artificial Sequence
  source: /note="Description of Artificial Sequence: Synthetic oligonucleotide"
guaacuaauugaaucauuaucuu

SEQ ID NO: 2134 - RNA, 23 nt, Artificial Sequence
  source: /note="Description of Artificial Sequence: Synthetic oligonucleotide"
agugguuuaugaauuguuuccuu

SEQ ID NO: 2135 - RNA, 23 nt, Artificial Sequence
  source: /note="Description of Artificial Sequence: Synthetic oligonucleotide"
uuuaguauaauggugcuauuuug

SEQ ID NO: 2136 - RNA, 23 nt, Artificial Sequence
  source: /note="Description of Artificial Sequence: Synthetic oligonucleotide"
uacuguuuaauaagcauauuuug

SEQ ID NO: 2137 - RNA, 23 nt, Artificial Sequence
  source: /note="Description of Artificial Sequence: Synthetic oligonucleotide"
caaaauaucaaaaccuuucaaau

SEQ ID NO: 2138 - RNA, 23 nt, Artificial Sequence
  source: /note="Description of Artificial Sequence: Synthetic oligonucleotide"
ggacagauguaaaagaaacuaua

SEQ ID NO: 2139 - RNA, 23 nt, Artificial Sequence
  source: /note="Description of Artificial Sequence: Synthetic oligonucleotide"
gcaacuuugaggccaaucauuuu

SEQ ID NO: 2140 - RNA, 19 nt, Artificial Sequence
  source: /note="Description of Artificial Sequence: Synthetic oligonucleotide"
uagauaaaugugaggauuu

SEQ ID NO: 2141 - RNA, 19 nt, Artificial Sequence
  source: /note="Description of Artificial Sequence: Synthetic oligonucleotide"
uucucuaaaucccucuucu

SEQ ID NO: 2142 - RNA, 19 nt, Artificial Sequence
  source: /note="Description of Artificial Sequence: Synthetic oligonucleotide"
cuguuugcuaaaucucacu

SEQ ID NO: 2143 - RNA, 19 nt, Artificial Sequence
  source: /note="Description of Artificial Sequence: Synthetic oligonucleotide"
cucacugucacugcuaaau

SEQ ID NO: 2144 - RNA, 19 nt, Artificial Sequence
  source: /note="Description of Artificial Sequence: Synthetic oligonucleotide"
uucagagcagauagagccu

SEQ ID NO: 2145 - RNA, 19 nt, Artificial Sequence
  source: /note="Description of Artificial Sequence: Synthetic oligonucleotide"
cauugcucucaacaucuca

SEQ ID NO: 2146 - RNA, 19 nt, Artificial Sequence
  source: /note="Description of Artificial Sequence: Synthetic oligonucleotide"
accaauucauuuucagacu

SEQ ID NO: 2147 - RNA, 19 nt, Artificial Sequence
  source: /note="Description of Artificial Sequence: Synthetic oligonucleotide"
uuuguacuucagaagcaau

SEQ ID NO: 2148 - RNA, 19 nt, Artificial Sequence
  source: /note="Description of Artificial Sequence: Synthetic oligonucleotide"
augggaaaaaucagcagua

SEQ ID NO: 2149 - RNA, 19 nt, Artificial Sequence
  source: /note="Description of Artificial Sequence: Synthetic oligonucleotide"
caauuauuuaagugcugcu

SEQ ID NO: 2150 - RNA, 19 nt, Artificial Sequence
  source: /note="Description of Artificial Sequence: Synthetic oligonucleotide"
uugaaggugaagaugcaca

SEQ ID NO: 2151 - RNA, 19 nt, Artificial Sequence
  source: /note="Description of Artificial Sequence: Synthetic oligonucleotide"
uuuuauuucaacaagccca

SEQ ID NO: 2152 - RNA, 19 nt, Artificial Sequence
  source: /note="Description of Artificial Sequence: Synthetic oligonucleotide"
cacaggguauggcuccaga

SEQ ID NO: 2153 - RNA, 19 nt, Artificial Sequence
  source: /note="Description of Artificial Sequence: Synthetic oligonucleotide"
cagcagucggagggcgccu

SEQ ID NO: 2154 - RNA, 19 nt, Artificial Sequence
  source: /note="Description of Artificial Sequence: Synthetic oligonucleotide"
uugcgcaccccucaagccu

SEQ ID NO: 2155 - RNA, 19 nt, Artificial Sequence
  source: /note="Description of Artificial Sequence: Synthetic oligonucleotide"
ugcaggaaacaagaacuaa

SEQ ID NO: 2156 - RNA, 19 nt, Artificial Sequence
  source: /note="Description of Artificial Sequence: Synthetic oligonucleotide"
caggauguaggaagacccu

SEQ ID NO: 2157 - RNA, 19 nt, Artificial Sequence
  source: /note="Description of Artificial Sequence: Synthetic oligonucleotide"
uuaaacuuuggaacaccua

SEQ ID NO: 2158 - RNA, 19 nt, Artificial Sequence
  source: /note="Description of Artificial Sequence: Synthetic oligonucleotide"
aaauaaguuugauaacauu

SEQ ID NO: 2159 - RNA, 19 nt, Artificial Sequence
  source: /note="Description of Artificial Sequence: Synthetic oligonucleotide"
uuaaaagaugggcguuuca

SEQ ID NO: 2160 - RNA, 19 nt, Artificial Sequence
  source: /note="Description of Artificial Sequence: Synthetic oligonucleotide"
aaauacacaaguaaacauu

SEQ ID NO: 2161 - RNA, 19 nt, Artificial Sequence
  source: /note="Description of Artificial Sequence: Synthetic oligonucleotide"
uuccaacauugucuuuaga

SEQ ID NO: 2162 - RNA, 19 nt, Artificial Sequence
  source: /note="Description of Artificial Sequence: Synthetic oligonucleotide"
ggagugauuugcaccuuga

SEQ ID NO: 2163 - RNA, 19 nt, Artificial Sequence
  source: /note="Description of Artificial Sequence: Synthetic oligonucleotide"
auugcuguugaucuuuuau

SEQ ID NO: 2164 - RNA, 19 nt, Artificial Sequence
  source: /note="Description of Artificial Sequence: Synthetic oligonucleotide"
ucaauaauguucuauagaa

SEQ ID NO: 2165 - RNA, 19 nt, Artificial Sequence
  source: /note="Description of Artificial Sequence: Synthetic oligonucleotide"
aaagaaaaaaaaaauauau

SEQ ID NO: 2166 - RNA, 19 nt, Artificial Sequence
  source: /note="Description of Artificial Sequence: Synthetic oligonucleotide"
auauauauauauaucuuaa

SEQ ID NO: 2167 - RNA, 19 nt, Artificial Sequence
  source: /note="Description of Artificial Sequence: Synthetic oligonucleotide"
uuuccuuauuugcacuucu

SEQ ID NO: 2168 - RNA, 19 nt, Artificial Sequence
  source: /note="Description of Artificial Sequence: Synthetic oligonucleotide"
cuuucuacacaacucggga

SEQ ID NO: 2169 - RNA, 19 nt, Artificial Sequence
  source: /note="Description of Artificial Sequence: Synthetic oligonucleotide"
gcuguuuguuuuacagugu

SEQ ID NO: 2170 - RNA, 19 nt, Artificial Sequence
  source: /note="Description of Artificial Sequence: Synthetic oligonucleotide"
uuacagugucugauaaucu

SEQ ID NO: 2171 - RNA, 19 nt, Artificial Sequence
  source: /note="Description of Artificial Sequence: Synthetic oligonucleotide"
cugauaaucuuguuagucu

SEQ ID NO: 2172 - RNA, 19 nt, Artificial Sequence
  source: /note="Description of Artificial Sequence: Synthetic oligonucleotide"
uauacccaccaccucccuu

SEQ ID NO: 2173 - RNA, 19 nt, Artificial Sequence
  source: /note="Description of Artificial Sequence: Synthetic oligonucleotide"
uugccgaauuuggccuccu

SEQ ID NO: 2174 - RNA, 19 nt, Artificial Sequence
  source: /note="Description of Artificial Sequence: Synthetic oligonucleotide"
gccgaauuuggccuccuca

SEQ ID NO: 2175 - RNA, 19 nt, Artificial Sequence
  source: /note="Description of Artificial Sequence: Synthetic oligonucleotide"
aaaagcagcagcaagucgu

SEQ ID NO: 2176 - RNA, 19 nt, Artificial Sequence
  source: /note="Description of Artificial Sequence: Synthetic oligonucleotide"
gucaagaagcacaccaauu

SEQ ID NO: 2177 - RNA, 19 nt, Artificial Sequence
  source: /note="Description of Artificial Sequence: Synthetic oligonucleotide"
aguuggaugcauuuuauuu

SEQ ID NO: 2178 - RNA, 19 nt, Artificial Sequence
  source: /note="Description of Artificial Sequence: Synthetic oligonucleotide"
uuagacacaaagcuuuauu

SEQ ID NO: 2179 - RNA, 19 nt, Artificial Sequence
  source: /note="Description of Artificial Sequence: Synthetic oligonucleotide"
cacaucaugcuuacaaaaa

SEQ ID NO: 2180 - RNA, 19 nt, Artificial Sequence
  source: /note="Description of Artificial Sequence: Synthetic oligonucleotide"
aagaauaaugcaaauaguu

SEQ ID NO: 2181 - RNA, 19 nt, Artificial Sequence
  source: /note="Description of Artificial Sequence: Synthetic oligonucleotide"
ugcaacuuugaggccaaua

SEQ ID NO: 2182 - RNA, 19 nt, Artificial Sequence
  source: /note="Description of Artificial Sequence: Synthetic oligonucleotide"
cauuuuuaggcauauguuu

SEQ ID NO: 2183 - RNA, 19 nt, Artificial Sequence
  source: /note="Description of Artificial Sequence: Synthetic oligonucleotide"
uuaaacauagaaaguuucu

SEQ ID NO: 2184 - RNA, 19 nt, Artificial Sequence
  source: /note="Description of Artificial Sequence: Synthetic oligonucleotide"
cuucaacucaaaagaguua

SEQ ID NO: 2185 - RNA, 19 nt, Artificial Sequence
  source: /note="Description of Artificial Sequence: Synthetic oligonucleotide"
uccuucaaaugaugaguua

SEQ ID NO: 2186 - RNA, 19 nt, Artificial Sequence
  source: /note="Description of Artificial Sequence: Synthetic oligonucleotide"
uuaguaacuuuccucuuuu

SEQ ID NO: 2187 - RNA, 19 nt, Artificial Sequence
  source: /note="Description of Artificial Sequence: Synthetic oligonucleotide"
uuuuuccauauagagcacu

SEQ ID NO: 2188 - RNA, 19 nt, Artificial Sequence
  source: /note="Description of Artificial Sequence: Synthetic oligonucleotide"
cuauguaaauuuagcauau

SEQ ID NO: 2189 - RNA, 19 nt, Artificial Sequence
  source: /note="Description of Artificial Sequence: Synthetic oligonucleotide"
aucaauuauacaggauaua

SEQ ID NO: 2190 - RNA, 19 nt, Artificial Sequence
  source: /note="Description of Artificial Sequence: Synthetic oligonucleotide"
uuuaguauaauggugcuau

SEQ ID NO: 2191 - RNA, 19 nt, Artificial Sequence
  source: /note="Description of Artificial Sequence: Synthetic oligonucleotide"
uuguuauaugaaagagucu

SEQ ID NO: 2192 - RNA, 19 nt, Artificial Sequence
  source: /note="Description of Artificial Sequence: Synthetic oligonucleotide"
acgguaauacgugaaagca

SEQ ID NO: 2193 - RNA, 19 nt, Artificial Sequence
  source: /note="Description of Artificial Sequence: Synthetic oligonucleotide"
aaaacaauaggggaagccu

SEQ ID NO: 2194 - RNA, 19 nt, Artificial Sequence
  source: /note="Description of Artificial Sequence: Synthetic oligonucleotide"
uacugaaaacaccauccau

SEQ ID NO: 2195 - RNA, 19 nt, Artificial Sequence
  source: /note="Description of Artificial Sequence: Synthetic oligonucleotide"
uugggaaagaaggcaaagu

SEQ ID NO: 2196 - RNA, 19 nt, Artificial Sequence
  source: /note="Description of Artificial Sequence: Synthetic oligonucleotide"
ucagacacaaaaguccacu

SEQ ID NO: 2197 - RNA, 19 nt, Artificial Sequence
  source: /note="Description of Artificial Sequence: Synthetic oligonucleotide"
cgaguccagagaggaaacu

SEQ ID NO: 2198 - RNA, 19 nt, Artificial Sequence
  source: /note="Description of Artificial Sequence: Synthetic oligonucleotide"
aaacuguggaauggaaaaa

SEQ ID NO: 2199 - RNA, 19 nt, Artificial Sequence
  source: /note="Description of Artificial Sequence: Synthetic oligonucleotide"
agcagaaggcuaggaauuu

SEQ ID NO: 2200 - RNA, 19 nt, Artificial Sequence
  source: /note="Description of Artificial Sequence: Synthetic oligonucleotide"
uuagcaguccugguuucuu

SEQ ID NO: 2201 - RNA, 19 nt, Artificial Sequence
  source: /note="Description of Artificial Sequence: Synthetic oligonucleotide"
caaaaugggggcaauaugu

SEQ ID NO: 2202 - RNA, 19 nt, Artificial Sequence
  source: /note="Description of Artificial Sequence: Synthetic oligonucleotide"
uuuaaaaagauaaagauua

SEQ ID NO: 2203 - RNA, 19 nt, Artificial Sequence
  source: /note="Description of Artificial Sequence: Synthetic oligonucleotide"
ucagauuuuuuuuacccua

SEQ ID NO: 2204 - RNA, 19 nt, Artificial Sequence
  source: /note="Description of Artificial Sequence: Synthetic oligonucleotide"
uuuuuuacccuggguugcu

SEQ ID NO: 2205 - RNA, 19 nt, Artificial Sequence
  source: /note="Description of Artificial Sequence: Synthetic oligonucleotide"
cuguaagggugcaacauca

SEQ ID NO: 2206 - RNA, 19 nt, Artificial Sequence
  source: /note="Description of Artificial Sequence: Synthetic oligonucleotide"
cugagaugcaaggaauucu

SEQ ID NO: 2207 - RNA, 19 nt, Artificial Sequence
  source: /note="Description of Artificial Sequence: Synthetic oligonucleotide"
uuggugaauugaaugcuca

SEQ ID NO: 2208 - RNA, 19 nt, Artificial Sequence
  source: /note="Description of Artificial Sequence: Synthetic oligonucleotide"
uucuugucagugaagcuau

SEQ ID NO: 2209 - RNA, 19 nt, Artificial Sequence
  source: /note="Description of Artificial Sequence: Synthetic oligonucleotide"
aauaacuggccaacuaguu

SEQ ID NO: 2210 - RNA, 19 nt, Artificial Sequence
  source: /note="Description of Artificial Sequence: Synthetic oligonucleotide"
uguuaaaagcuaacagcua

SEQ ID NO: 2211 - RNA, 19 nt, Artificial Sequence
  source: /note="Description of Artificial Sequence: Synthetic oligonucleotide"
caaucucuuaaaacacuuu

SEQ ID NO: 2212 - RNA, 19 nt, Artificial Sequence
  source: /note="Description of Artificial Sequence: Synthetic oligonucleotide"
aaaauaugugggaagcauu

SEQ ID NO: 2213 - RNA, 19 nt, Artificial Sequence
  source: /note="Description of Artificial Sequence: Synthetic oligonucleotide"
uuugauuuucaauuugauu

SEQ ID NO: 2214 - RNA, 19 nt, Artificial Sequence
  source: /note="Description of Artificial Sequence: Synthetic oligonucleotide"
uugaauucugcauuugguu

SEQ ID NO: 2215 - RNA, 19 nt, Artificial Sequence
  source: /note="Description of Artificial Sequence: Synthetic oligonucleotide"
uuuaugaauacaaagauaa

SEQ ID NO: 2216 - RNA, 19 nt, Artificial Sequence
  source: /note="Description of Artificial Sequence: Synthetic oligonucleotide"
gugaaaagagagaaaggaa

SEQ ID NO: 2217 - RNA, 19 nt, Artificial Sequence
  source: /note="Description of Artificial Sequence: Synthetic oligonucleotide"
aaagaaaaaggagaaaaac

SEQ ID NO: 2218 - RNA, 19 nt, Artificial Sequence
  source: /note="Description of Artificial Sequence: Synthetic oligonucleotide"
acaaagagauuucuaccaa

SEQ ID NO: 2219 - RNA, 19 nt, Artificial Sequence
  source: /note="Description of Artificial Sequence: Synthetic oligonucleotide"
uuguuagcacucacugacu

SEQ ID NO: 2220 - RNA, 19 nt, Artificial Sequence
  source: /note="Description of Artificial Sequence: Synthetic oligonucleotide"
uacauaucuaguaaaaccu

SEQ ID NO: 2221 - RNA, 19 nt, Artificial Sequence
  source: /note="Description of Artificial Sequence: Synthetic oligonucleotide"
cucguuuaauacuauaaau

SEQ ID NO: 2222 - RNA, 19 nt, Artificial Sequence
  source: /note="Description of Artificial Sequence: Synthetic oligonucleotide"
uuuaauacuauaaauaaua

SEQ ID NO: 2223 - RNA, 19 nt, Artificial Sequence
  source: /note="Description of Artificial Sequence: Synthetic oligonucleotide"
uauucuauucauuuugaaa

SEQ ID NO: 2224 - RNA, 19 nt, Artificial Sequence
  source: /note="Description of Artificial Sequence: Synthetic oligonucleotide"
uuugaaaaacacaaugauu

SEQ ID NO: 2225 - RNA, 19 nt, Artificial Sequence
  source: /note="Description of Artificial Sequence: Synthetic oligonucleotide"
aaggaaagugauccaaaau

SEQ ID NO: 2226 - RNA, 19 nt, Artificial Sequence
  source: /note="Description of Artificial Sequence: Synthetic oligonucleotide"
uuugaaauauuaaaauaau

SEQ ID NO: 2227 - RNA, 19 nt, Artificial Sequence
  source: /note="Description of Artificial Sequence: Synthetic oligonucleotide"
uuaaaauaauaucuaauaa

SEQ ID NO: 2228 - RNA, 19 nt, Artificial Sequence
  source: /note="Description of Artificial Sequence: Synthetic oligonucleotide"
aaaagucacaaaguuaucu

SEQ ID NO: 2229 - RNA, 19 nt, Artificial Sequence
  source: /note="Description of Artificial Sequence: Synthetic oligonucleotide"
uucuuuaacaaacuuuacu

SEQ ID NO: 2230 - RNA, 19 nt, Artificial Sequence
  source: /note="Description of Artificial Sequence: Synthetic oligonucleotide"
cucuuauucuuagcuguau

SEQ ID NO: 2231 - RNA, 19 nt, Artificial Sequence
  source: /note="Description of Artificial Sequence: Synthetic oligonucleotide"
auauacauuuuuuuaaaag

SEQ ID NO: 2232 - RNA, 19 nt, Artificial Sequence
  source: /note="Description of Artificial Sequence: Synthetic oligonucleotide"
cauuuuuuuaaaaguuugu

SEQ ID NO: 2233 - RNA, 19 nt, Artificial Sequence
  source: /note="Description of Artificial Sequence: Synthetic oligonucleotide"
guuaaaauaugcuugacua

SEQ ID NO: 2234 - RNA, 19 nt, Artificial Sequence
  source: /note="Description of Artificial Sequence: Synthetic oligonucleotide"
augcuugacuagaguuuca

SEQ ID NO: 2235 - RNA, 19 nt, Artificial Sequence
  source: /note="Description of Artificial Sequence: Synthetic oligonucleotide"
caguugaaaggcaaaaacu

SEQ ID NO: 2236 - RNA, 19 nt, Artificial Sequence
  source: /note="Description of Artificial Sequence: Synthetic oligonucleotide"
uuccaucacaacaagaaau

SEQ ID NO: 2237 - RNA, 19 nt, Artificial Sequence
  source: /note="Description of Artificial Sequence: Synthetic oligonucleotide"
uugguaucaagaaagucca

SEQ ID NO: 2238 - RNA, 19 nt, Artificial Sequence
  source: /note="Description of Artificial Sequence: Synthetic oligonucleotide"
guuaguguacuaguccaua

SEQ ID NO: 2239 - RNA, 19 nt, Artificial Sequence
  source: /note="Description of Artificial Sequence: Synthetic oligonucleotide"
cauagccuagaaaaugaua

SEQ ID NO: 2240 - RNA, 19 nt, Artificial Sequence
  source: /note="Description of Artificial Sequence: Synthetic oligonucleotide"
ucccuaucugcagaucaaa

SEQ ID NO: 2241 - RNA, 19 nt, Artificial Sequence
  source: /note="Description of Artificial Sequence: Synthetic oligonucleotide"
uuauccagcauucagaucu

SEQ ID NO: 2242 - RNA, 19 nt, Artificial Sequence
  source: /note="Description of Artificial Sequence: Synthetic oligonucleotide"
uuuuugguuaaaaguacca

SEQ ID NO: 2243 - RNA, 19 nt, Artificial Sequence
  source: /note="Description of Artificial Sequence: Synthetic oligonucleotide"
uacccaggcuugauuauuu

SEQ ID NO: 2244 - RNA, 19 nt, Artificial Sequence
  source: /note="Description of Artificial Sequence: Synthetic oligonucleotide"
ucaugcaaauucuauauuu

SEQ ID NO: 2245 - RNA, 19 nt, Artificial Sequence
  source: /note="Description of Artificial Sequence: Synthetic oligonucleotide"
uuacauucuuggaaagucu

SEQ ID NO: 2246 - RNA, 19 nt, Artificial Sequence
  source: /note="Description of Artificial Sequence: Synthetic oligonucleotide"
ucuuggaaagucuauauga

SEQ ID NO: 2247 - RNA, 19 nt, Artificial Sequence
  source: /note="Description of Artificial Sequence: Synthetic oligonucleotide"
aaaaacaaaaauaacaucu

SEQ ID NO: 2248 - RNA, 19 nt, Artificial Sequence
  source: /note="Description of Artificial Sequence: Synthetic oligonucleotide"
uucucccacugggucaccu

SEQ ID NO: 2249 - RNA, 19 nt, Artificial Sequence
  source: /note="Description of Artificial Sequence: Synthetic oligonucleotide"
caaggaucagaggccagga

SEQ ID NO: 2250 - RNA, 19 nt, Artificial Sequence
  source: /note="Description of Artificial Sequence: Synthetic oligonucleotide"
aaaaaaaaaaaaaagacua

SEQ ID NO: 2251 - RNA, 19 nt, Artificial Sequence
  source: /note="Description of Artificial Sequence: Synthetic oligonucleotide"
ucccuggaucucugaauau

SEQ ID NO: 2252 - RNA, 19 nt, Artificial Sequence
  source: /note="Description of Artificial Sequence: Synthetic oligonucleotide"
auaugcaaaaagaaggcca

SEQ ID NO: 2253 - RNA, 19 nt, Artificial Sequence
  source: /note="Description of Artificial Sequence: Synthetic oligonucleotide"
uaguggagccagcaauccu

SEQ ID NO: 2254 - RNA, 19 nt, Artificial Sequence
  source: /note="Description of Artificial Sequence: Synthetic oligonucleotide"
uuaacucucaguccaacau

SEQ ID NO: 2255 - RNA, 19 nt, Artificial Sequence
  source: /note="Description of Artificial Sequence: Synthetic oligonucleotide"
uuauuugaauugagcaccu

SEQ ID NO: 2256 - RNA, 19 nt, Artificial Sequence
  source: /note="Description of Artificial Sequence: Synthetic oligonucleotide"
cagauguaaaagaaacuau

SEQ ID NO: 2257 - RNA, 19 nt, Artificial Sequence
  source: /note="Description of Artificial Sequence: Synthetic oligonucleotide"
auacaucauuuuugcccua

SEQ ID NO: 2258 - RNA, 19 nt, Artificial Sequence
  source: /note="Description of Artificial Sequence: Synthetic oligonucleotide"
uuuugcccucugccuguuu

SEQ ID NO: 2259 - RNA, 19 nt, Artificial Sequence
  source: /note="Description of Artificial Sequence: Synthetic oligonucleotide"
uuccagacauacagguucu

SEQ ID NO: 2260 - RNA, 19 nt, Artificial Sequence
  source: /note="Description of Artificial Sequence: Synthetic oligonucleotide"
cuguggaauaagauacuga

SEQ ID NO: 2261 - RNA, 19 nt, Artificial Sequence
  source: /note="Description of Artificial Sequence: Synthetic oligonucleotide"
uaagauacuggacuccucu

SEQ ID NO: 2262 - RNA, 19 nt, Artificial Sequence
  source: /note="Description of Artificial Sequence: Synthetic oligonucleotide"
cuucccaagauggcacuua

SEQ ID NO: 2263 - RNA, 19 nt, Artificial Sequence
  source: /note="Description of Artificial Sequence: Synthetic oligonucleotide"
guguaccuuuuaaaauuau

SEQ ID NO: 2264 - RNA, 19 nt, Artificial Sequence
  source: /note="Description of Artificial Sequence: Synthetic oligonucleotide"
uucccucucaacaaaacuu

SEQ ID NO: 2265 - RNA, 19 nt, Artificial Sequence
  source: /note="Description of Artificial Sequence: Synthetic oligonucleotide"
uuuauaggcagucuucuga

SEQ ID NO: 2266 - RNA, 19 nt, Artificial Sequence
  source: /note="Description of Artificial Sequence: Synthetic oligonucleotide"
uuuucugucauaguuagau

SEQ ID NO: 2267 - RNA, 19 nt, Artificial Sequence
  source: /note="Description of Artificial Sequence: Synthetic oligonucleotide"
augugauaauucuaagagu

SEQ ID NO: 2268 - RNA, 19 nt, Artificial Sequence
  source: /note="Description of Artificial Sequence: Synthetic oligonucleotide"
uuccuucacuuaauucuau

SEQ ID NO: 2269 - RNA, 19 nt, Artificial Sequence
  source: /note="Description of Artificial Sequence: Synthetic oligonucleotide"
auuaucuuucuuaacuuuu

SEQ ID NO: 2270 - RNA, 19 nt, Artificial Sequence
  source: /note="Description of Artificial Sequence: Synthetic oligonucleotide"
uuccaacacauaauccucu

SEQ ID NO: 2271 - RNA, 19 nt, Artificial Sequence
  source: /note="Description of Artificial Sequence: Synthetic oligonucleotide"
aaauaaauugaaaauaacu

SEQ ID NO: 2272 - RNA, 19 nt, Artificial Sequence
  source: /note="Description of Artificial Sequence: Synthetic oligonucleotide"
ucauuauaccaauucacua

SEQ ID NO: 2273 - RNA, 19 nt, Artificial Sequence
  source: /note="Description of Artificial Sequence: Synthetic oligonucleotide"
auuuuauuuuuuaaugaau

SEQ ID NO: 2274 - RNA, 19 nt, Artificial Sequence
  source: /note="Description of Artificial Sequence: Synthetic oligonucleotide"
uuaaaacuagaaaacaaau

SEQ ID NO: 2275 - RNA, 19 nt, Artificial Sequence
  source: /note="Description of Artificial Sequence: Synthetic oligonucleotide"
uugauuacuauauacuaca

SEQ ID NO: 2276 - RNA, 19 nt, Artificial Sequence
  source: /note="Description of Artificial Sequence: Synthetic oligonucleotide"
augacucagauuucauaga

SEQ ID NO: 2277 - RNA, 19 nt, Artificial Sequence
  source: /note="Description of Artificial Sequence: Synthetic oligonucleotide"
aaaggagcaaccaaaaugu

SEQ ID NO: 2278 - RNA, 19 nt, Artificial Sequence
  source: /note="Description of Artificial Sequence: Synthetic oligonucleotide"
gucacaacccaaaacuuua

SEQ ID NO: 2279 - RNA, 19 nt, Artificial Sequence
  source: /note="Description of Artificial Sequence: Synthetic oligonucleotide"
aaacuuuacaagcuuugcu

SEQ ID NO: 2280 - RNA, 19 nt, Artificial Sequence
  source: /note="Description of Artificial Sequence: Synthetic oligonucleotide"
uucagaauuagauugcuuu

SEQ ID NO: 2281 - RNA, 19 nt, Artificial Sequence
  source: /note="Description of Artificial Sequence: Synthetic oligonucleotide"
uuauaauucuugaaugaga

SEQ ID NO: 2282 - RNA, 19 nt, Artificial Sequence
  source: /note="Description of Artificial Sequence: Synthetic oligonucleotide"
uaauucuugaaugaggcaa

SEQ ID NO: 2283 - RNA, 19 nt, Artificial Sequence
  source: /note="Description of Artificial Sequence: Synthetic oligonucleotide"
auuucaagauauuuguaaa

SEQ ID NO: 2284 - RNA, 19 nt, Artificial Sequence
  source: /note="Description of Artificial Sequence: Synthetic oligonucleotide"
aagaacaguaaacauuggu

SEQ ID NO: 2285 - RNA, 19 nt, Artificial Sequence
  source: /note="Description of Artificial Sequence: Synthetic oligonucleotide"
uuucaacucauaggcuuau

SEQ ID NO: 2286 - RNA, 19 nt, Artificial Sequence
  source: /note="Description of Artificial Sequence: Synthetic oligonucleotide"
uugaccauacuggauacuu

SEQ ID NO: 2287 - RNA, 19 nt, Artificial Sequence
  source: /note="Description of Artificial Sequence: Synthetic oligonucleotide"
uuuaagaugaggcaguuca

SEQ ID NO: 2288 - RNA, 19 nt, Artificial Sequence
  source: /note="Description of Artificial Sequence: Synthetic oligonucleotide"
caucagaauccacucuucu

SEQ ID NO: 2289 - RNA, 19 nt, Artificial Sequence
  source: /note="Description of Artificial Sequence: Synthetic oligonucleotide"
uagggauaugaaaaucucu

SEQ ID NO: 2290 - RNA, 19 nt, Artificial Sequence
  source: /note="Description of Artificial Sequence: Synthetic oligonucleotide"
uucacccuaaggauccaau

SEQ ID NO: 2291 - RNA, 19 nt, Artificial Sequence
  source: /note="Description of Artificial Sequence: Synthetic oligonucleotide"
auggaauacugaaaagaaa

SEQ ID NO: 2292 - RNA, 19 nt, Artificial Sequence
  source: /note="Description of Artificial Sequence: Synthetic oligonucleotide"
gaauacugaaaagaaauca

SEQ ID NO: 2293 - RNA, 19 nt, Artificial Sequence
  source: /note="Description of Artificial Sequence: Synthetic oligonucleotide"
acuuccuugaaaauuuuau

SEQ ID NO: 2294 - RNA, 19 nt, Artificial Sequence
  source: /note="Description of Artificial Sequence: Synthetic oligonucleotide"
uuaaaaaacaaacaaacaa

SEQ ID NO: 2295 - RNA, 19 nt, Artificial Sequence
  source: /note="Description of Artificial Sequence: Synthetic oligonucleotide"
aaacaaaaagccuguccaa

SEQ ID NO: 2296 - RNA, 19 nt, Artificial Sequence
  source: /note="Description of Artificial Sequence: Synthetic oligonucleotide"
uuuguguagaugaaaccau

SEQ ID NO: 2297 - RNA, 19 nt, Artificial Sequence
  source: /note="Description of Artificial Sequence: Synthetic oligonucleotide"
uugggagaaggcuuagaau

SEQ ID NO: 2298 - RNA, 19 nt, Artificial Sequence
  source: /note="Description of Artificial Sequence: Synthetic oligonucleotide"
uaaaagauguagcacauuu

SEQ ID NO: 2299 - RNA, 19 nt, Artificial Sequence
  source: /note="Description of Artificial Sequence: Synthetic oligonucleotide"
uuauuguuuggccagcuau

SEQ ID NO: 2300 - RNA, 19 nt, Artificial Sequence
  source: /note="Description of Artificial Sequence: Synthetic oligonucleotide"
augccaauguggugcuauu

SEQ ID NO: 2301 - RNA, 19 nt, Artificial Sequence
  source: /note="Description of Artificial Sequence: Synthetic oligonucleotide"
aauguggugcuauuguuua

SEQ ID NO: 2302 - RNA, 19 nt, Artificial Sequence
  source: /note="Description of Artificial Sequence: Synthetic oligonucleotide"
cuuuaagaaaguacuugaa

SEQ ID NO: 2303 - RNA, 19 nt, Artificial Sequence
  source: /note="Description of Artificial Sequence: Synthetic oligonucleotide"
cuaaaaaaaaaagaaaaaa

SEQ ID NO: 2304 - RNA, 19 nt, Artificial Sequence
  source: /note="Description of Artificial Sequence: Synthetic oligonucleotide"
aagaaaaaaaagaaagcau

SEQ ID NO: 2305 - RNA, 19 nt, Artificial Sequence
  source: /note="Description of Artificial Sequence: Synthetic oligonucleotide"
auagacauauuuuuuuaaa

SEQ ID NO: 2306 - RNA, 19 nt, Artificial Sequence
  source: /note="Description of Artificial Sequence: Synthetic oligonucleotide"
uuaaaguauaaaaacaaca

SEQ ID NO: 2307 - RNA, 19 nt, Artificial Sequence
  source: /note="Description of Artificial Sequence: Synthetic oligonucleotide"
caauucuauagauagauga

SEQ ID NO: 2308 - RNA, 19 nt, Artificial Sequence
  source: /note="Description of Artificial Sequence: Synthetic oligonucleotide"
ggcuuaauaaaauagcauu

SEQ ID NO: 2309 - RNA, 19 nt, Artificial Sequence
  source: /note="Description of Artificial Sequence: Synthetic oligonucleotide"
uaauaaaauagcauuaggu

SEQ ID NO: 2310 - RNA, 19 nt, Artificial Sequence
  source: /note="Description of Artificial Sequence: Synthetic oligonucleotide"
uaucuagccaccaccaccu

SEQ ID NO: 2311 - RNA, 19 nt, Artificial Sequence
  source: /note="Description of Artificial Sequence: Synthetic oligonucleotide"
uuuaucacucacaaguagu

SEQ ID NO: 2312 - RNA, 19 nt, Artificial Sequence
  source: /note="Description of Artificial Sequence: Synthetic oligonucleotide"
ggcaggaguuggaaauuuu

SEQ ID NO: 2313 - RNA, 19 nt, Artificial Sequence
  source: /note="Description of Artificial Sequence: Synthetic oligonucleotide"
uuuaaaguuagaaggcuca

SEQ ID NO: 2314 - RNA, 19 nt, Artificial Sequence
  source: /note="Description of Artificial Sequence: Synthetic oligonucleotide"
ccauuguuuuguuggcucu

SEQ ID NO: 2315 - RNA, 19 nt, Artificial Sequence
  source: /note="Description of Artificial Sequence: Synthetic oligonucleotide"
uuagcaaaauuagcaauau

SEQ ID NO: 2316 - RNA, 19 nt, Artificial Sequence
  source: /note="Description of Artificial Sequence: Synthetic oligonucleotide"
auauuauccaaucuucuga

SEQ ID NO: 2317 - RNA, 19 nt, Artificial Sequence
  source: /note="Description of Artificial Sequence: Synthetic oligonucleotide"
uuauccaaucuucugaacu

SEQ ID NO: 2318 - RNA, 19 nt, Artificial Sequence
  source: /note="Description of Artificial Sequence: Synthetic oligonucleotide"
aagagcauggagaauaaac

SEQ ID NO: 2319 - RNA, 19 nt, Artificial Sequence
  source: /note="Description of Artificial Sequence: Synthetic oligonucleotide"
acgcgggaaaaaagaucuu

SEQ ID NO: 2320 - RNA, 19 nt, Artificial Sequence
  source: /note="Description of Artificial Sequence: Synthetic oligonucleotide"
gaucuuauaggcaaauaga

SEQ ID NO: 2321 - RNA, 19 nt, Artificial Sequence
  source: /note="Description of Artificial Sequence: Synthetic oligonucleotide"
aagaauuuaaaagauaagu

SEQ ID NO: 2322 - RNA, 19 nt, Artificial Sequence
  source: /note="Description of Artificial Sequence: Synthetic oligonucleotide"
guaaguuccuuauugauuu

SEQ ID NO: 2323 - RNA, 19 nt, Artificial Sequence
  source: /note="Description of Artificial Sequence: Synthetic oligonucleotide"
uuuugugcacucugcucua

SEQ ID NO: 2324 - RNA, 19 nt, Artificial Sequence
  source: /note="Description of Artificial Sequence: Synthetic oligonucleotide"
aaacagauauucagcaagu

SEQ ID NO: 2325 - RNA, 19 nt, Artificial Sequence
  source: /note="Description of Artificial Sequence: Synthetic oligonucleotide"
ucagcaaguggagaaaaua

SEQ ID NO: 2326 - RNA, 19 nt, Artificial Sequence
  source: /note="Description of Artificial Sequence: Synthetic oligonucleotide"
aagaacaaagagaaaaaau

SEQ ID NO: 2327 - RNA, 19 nt, Artificial Sequence
  source: /note="Description of Artificial Sequence: Synthetic oligonucleotide"
auacauagauuuaccugca

SEQ ID NO: 2328 - RNA, 19 nt, Artificial Sequence
  source: /note="Description of Artificial Sequence: Synthetic oligonucleotide"
uuaccugcaaaaaauagcu

SEQ ID NO: 2329 - RNA, 19 nt, Artificial Sequence
  source: /note="Description of Artificial Sequence: Synthetic oligonucleotide"
uuuauagaagacauucuca

SEQ ID NO: 2330 - RNA, 19 nt, Artificial Sequence
  source: /note="Description of Artificial Sequence: Synthetic oligonucleotide"
agacaucucaaagagcagu

SEQ ID NO: 2331 - RNA, 19 nt, Artificial Sequence
  source: /note="Description of Artificial Sequence: Synthetic oligonucleotide"
uaugagauggggguuaucu

SEQ ID NO: 2332 - RNA, 19 nt, Artificial Sequence
  source: /note="Description of Artificial Sequence: Synthetic oligonucleotide"
cuacugauaaagaaagaau

SEQ ID NO: 2333 - RNA, 19 nt, Artificial Sequence
  source: /note="Description of Artificial Sequence: Synthetic oligonucleotide"
aaagaauuuaugagaaauu

SEQ ID NO: 2334 - RNA, 19 nt, Artificial Sequence
  source: /note="Description of Artificial Sequence: Synthetic oligonucleotide"
uaacaaucugugaagauuu

SEQ ID NO: 2335 - RNA, 19 nt, Artificial Sequence
  source: /note="Description of Artificial Sequence: Synthetic oligonucleotide"
uuuuacuuuauacagucuu

SEQ ID NO: 2336 - RNA, 19 nt, Artificial Sequence
  source: /note="Description of Artificial Sequence: Synthetic oligonucleotide"
uuuaugaauuucuuaaugu

SEQ ID NO: 2337 - RNA, 19 nt, Artificial Sequence
  source: /note="Description of Artificial Sequence: Synthetic oligonucleotide"
uuaauguucaaaaugacuu

SEQ ID NO: 2338 - RNA, 19 nt, Artificial Sequence
  source: /note="Description of Artificial Sequence: Synthetic oligonucleotide"
uucuucuuuuuuuauauca

SEQ ID NO: 2339 - RNA, 19 nt, Artificial Sequence
  source: /note="Description of Artificial Sequence: Synthetic oligonucleotide"
agaaugaggaauaauaagu

SEQ ID NO: 2340 - RNA, 19 nt, Artificial Sequence
  source: /note="Description of Artificial Sequence: Synthetic oligonucleotide"
uuaaacccacauagacucu

SEQ ID NO: 2341 - RNA, 19 nt, Artificial Sequence
  source: /note="Description of Artificial Sequence: Synthetic oligonucleotide"
cuuuaaaacuauaggcuaa

SEQ ID NO: 2342 - RNA, 19 nt, Artificial Sequence
  source: /note="Description of Artificial Sequence: Synthetic oligonucleotide"
agauagaaauguauguuua

SEQ ID NO: 2343 - RNA, 19 nt, Artificial Sequence
  source: /note="Description of Artificial Sequence: Synthetic oligonucleotide"
uuugacuuguugaagcuau

SEQ ID NO: 2344 - RNA, 19 nt, Artificial Sequence
  source: /note="Description of Artificial Sequence: Synthetic oligonucleotide"
uuuuuaaucuuaaaagauu

SEQ ID NO: 2345 - RNA, 19 nt, Artificial Sequence
  source: /note="Description of Artificial Sequence: Synthetic oligonucleotide"
uugugcuaauuuauuagaa

SEQ ID NO: 2346 - RNA, 19 nt, Artificial Sequence
  source: /note="Description of Artificial Sequence: Synthetic oligonucleotide"
uuauuagagcagaaccugu

SEQ ID NO: 2347 - RNA, 19 nt, Artificial Sequence
  source: /note="Description of Artificial Sequence: Synthetic oligonucleotide"
guuuggcucuccucagaaa

SEQ ID NO: 2348 - RNA, 19 nt, Artificial Sequence
  source: /note="Description of Artificial Sequence: Synthetic oligonucleotide"
caauauuuucaaaagauaa

SEQ ID NO: 2349 - RNA, 19 nt, Artificial Sequence
  source: /note="Description of Artificial Sequence: Synthetic oligonucleotide"
ucaaaagauaaaucugauu

SEQ ID NO: 2350 - RNA, 19 nt, Artificial Sequence
  source: /note="Description of Artificial Sequence: Synthetic oligonucleotide"
uuaugcaauggcaucauuu

SEQ ID NO: 2351 - RNA, 19 nt, Artificial Sequence
  source: /note="Description of Artificial Sequence: Synthetic oligonucleotide"
ugcaauggcaucauuuauu

SEQ ID NO: 2352 - RNA, 19 nt, Artificial Sequence
  source: /note="Description of Artificial Sequence: Synthetic oligonucleotide"
uuuaaaacagaagaauugu

SEQ ID NO: 2353 - RNA, 19 nt, Artificial Sequence
  source: /note="Description of Artificial Sequence: Synthetic oligonucleotide"
aacaacaaaaggaaaaugu

SEQ ID NO: 2354 - RNA, 19 nt, Artificial Sequence
  source: /note="Description of Artificial Sequence: Synthetic oligonucleotide"
uuaauccuguaguacauau

SEQ ID NO: 2355 - RNA, 19 nt, Artificial Sequence
  source: /note="Description of Artificial Sequence: Synthetic oligonucleotide"
uuuaauauuuuauaagaca

SEQ ID NO: 2356 - RNA, 19 nt, Artificial Sequence
  source: /note="Description of Artificial Sequence: Synthetic oligonucleotide"
ccuuccuguuagguauuaa

SEQ ID NO: 2357 - RNA, 19 nt, Artificial Sequence
  source: /note="Description of Artificial Sequence: Synthetic oligonucleotide"
uuagguauuagaaagugau

SEQ ID NO: 2358 - RNA, 19 nt, Artificial Sequence
  source: /note="Description of Artificial Sequence: Synthetic oligonucleotide"
auacauagauaucuuuuuu

SEQ ID NO: 2359 - RNA, 19 nt, Artificial Sequence
  source: /note="Description of Artificial Sequence: Synthetic oligonucleotide"
uuuuuguguaauuucuauu

SEQ ID NO: 2360 - RNA, 19 nt, Artificial Sequence
  source: /note="Description of Artificial Sequence: Synthetic oligonucleotide"
uuaaaaaagagagaagacu

SEQ ID NO: 2361 - RNA, 19 nt, Artificial Sequence
  source: /note="Description of Artificial Sequence: Synthetic oligonucleotide"
cugucagaagcuuuaagua

SEQ ID NO: 2362 - RNA, 19 nt, Artificial Sequence
  source: /note="Description of Artificial Sequence: Synthetic oligonucleotide"
uaugguacaggauaaagau

SEQ ID NO: 2363 - RNA, 19 nt, Artificial Sequence
  source: /note="Description of Artificial Sequence: Synthetic oligonucleotide"
uuaaauaaccaauuccuau

SEQ ID NO: 2364 - RNA, 19 nt, Artificial Sequence
  source: /note="Description of Artificial Sequence: Synthetic oligonucleotide"
uuguuuuuuaaagaaaccu

SEQ ID NO: 2365 - RNA, 19 nt, Artificial Sequence
  source: /note="Description of Artificial Sequence: Synthetic oligonucleotide"
cucucacagauaagacaga

SEQ ID NO: 2366 - RNA, 19 nt, Artificial Sequence
  source: /note="Description of Artificial Sequence: Synthetic oligonucleotide"
cagaauuuuauagagggcu

SEQ ID NO: 2367 - RNA, 19 nt, Artificial Sequence
  source: /note="Description of Artificial Sequence: Synthetic oligonucleotide"
ucuagaauuaaaggaaccu

SEQ ID NO: 2368 - RNA, 19 nt, Artificial Sequence
  source: /note="Description of Artificial Sequence: Synthetic oligonucleotide"
cucacugaaaacauauauu

SEQ ID NO: 2369 - RNA, 19 nt, Artificial Sequence
  source: /note="Description of Artificial Sequence: Synthetic oligonucleotide"
aaacauauauuucacgugu

SEQ ID NO: 2370 - RNA, 19 nt, Artificial Sequence
  source: /note="Description of Artificial Sequence: Synthetic oligonucleotide"
guucccucuuuuuuuuuuu

SEQ ID NO: 2371 - RNA, 19 nt, Artificial Sequence
  source: /note="Description of Artificial Sequence: Synthetic oligonucleotide"
uuaagcgauucuccugccu

SEQ ID NO: 2372 - RNA, 19 nt, Artificial Sequence
  source: /note="Description of Artificial Sequence: Synthetic oligonucleotide"
cggcuaauuuuuuggauuu

SEQ ID NO: 2373 - RNA, 19 nt, Artificial Sequence
  source: /note="Description of Artificial Sequence: Synthetic oligonucleotide"
uuuaauagagacgggguuu

SEQ ID NO: 2374 - RNA, 19 nt, Artificial Sequence
  source: /note="Description of Artificial Sequence: Synthetic oligonucleotide"
uuuaccauguuggccaggu

SEQ ID NO: 2375 - RNA, 19 nt, Artificial Sequence
  source: /note="Description of Artificial Sequence: Synthetic oligonucleotide"
uugcugggauuacaggcau

SEQ ID NO: 2376 - RNA, 19 nt, Artificial Sequence
  source: /note="Description of Artificial Sequence: Synthetic oligonucleotide"
uuaaacaugauccuucucu

SEQ ID NO: 2377 - RNA, 19 nt, Artificial Sequence
  source: /note="Description of Artificial Sequence: Synthetic oligonucleotide"
ggggucuuucaaggggaaa

SEQ ID NO: 2378 - RNA, 19 nt, Artificial Sequence
  source: /note="Description of Artificial Sequence: Synthetic oligonucleotide"
aaaaauccaagcuuuuuua

SEQ ID NO: 2379 - RNA, 19 nt, Artificial Sequence
  source: /note="Description of Artificial Sequence: Synthetic oligonucleotide"
aaaguaaaaaaaaaaaaag

SEQ ID NO: 2380 - RNA, 19 nt, Artificial Sequence
  source: /note="Description of Artificial Sequence: Synthetic oligonucleotide"
agagaggacacaaaaccaa

SEQ ID NO: 2381 - RNA, 19 nt, Artificial Sequence
  source: /note="Description of Artificial Sequence: Synthetic oligonucleotide"
uuaagauggagacagaguu

SEQ ID NO: 2382 - RNA, 19 nt, Artificial Sequence
  source: /note="Description of Artificial Sequence: Synthetic oligonucleotide"
uuucuccuaauaaccggaa

SEQ ID NO: 2383 - RNA, 19 nt, Artificial Sequence
  source: /note="Description of Artificial Sequence: Synthetic oligonucleotide"
gcugaauuaccuuucacuu

SEQ ID NO: 2384 - RNA, 19 nt, Artificial Sequence
  source: /note="Description of Artificial Sequence: Synthetic oligonucleotide"
uucaaaaacaugaccuuca

SEQ ID NO: 2385 - RNA, 19 nt, Artificial Sequence
  source: /note="Description of Artificial Sequence: Synthetic oligonucleotide"
caauccuuagaaucugccu

SEQ ID NO: 2386 - RNA, 19 nt, Artificial Sequence
  source: /note="Description of Artificial Sequence: Synthetic oligonucleotide"
uuuuauauuacugaggccu

SEQ ID NO: 2387 - RNA, 19 nt, Artificial Sequence
  source: /note="Description of Artificial Sequence: Synthetic oligonucleotide"
aaaaguaaacauuacucau

SEQ ID NO: 2388 - RNA, 19 nt, Artificial Sequence
  source: /note="Description of Artificial Sequence: Synthetic oligonucleotide"
uuuauuuugcccaaaauga

SEQ ID NO: 2389 - RNA, 19 nt, Artificial Sequence
  source: /note="Description of Artificial Sequence: Synthetic oligonucleotide"
cacugauguaaaguaggaa

SEQ ID NO: 2390 - RNA, 19 nt, Artificial Sequence
  source: /note="Description of Artificial Sequence: Synthetic oligonucleotide"
aaaauaaaaacagagcucu

SEQ ID NO: 2391 - RNA, 19 nt, Artificial Sequence
  source: /note="Description of Artificial Sequence: Synthetic oligonucleotide"
cuaaaaucccuuucaagca

SEQ ID NO: 2392 - RNA, 19 nt, Artificial Sequence
  source: /note="Description of Artificial Sequence: Synthetic oligonucleotide"
uugaccccacucaccaacu

SEQ ID NO: 2393 - RNA, 19 nt, Artificial Sequence
  source: /note="Description of Artificial Sequence: Synthetic oligonucleotide"
uuaucuuguacccgcugcu

SEQ ID NO: 2394 - RNA, 19 nt, Artificial Sequence
  source: /note="Description of Artificial Sequence: Synthetic oligonucleotide"
cugaaaccucaagcugucu

SEQ ID NO: 2395 - RNA, 19 nt, Artificial Sequence
  source: /note="Description of Artificial Sequence: Synthetic oligonucleotide"
guaucaugaaaaugucuau

SEQ ID NO: 2396 - RNA, 19 nt, Artificial Sequence
  source: /note="Description of Artificial Sequence: Synthetic oligonucleotide"
uucaaaauaucaaaaccuu

SEQ ID NO: 2397 - RNA, 19 nt, Artificial Sequence
  source: /note="Description of Artificial Sequence: Synthetic oligonucleotide"
uuucaaauaucacgcagcu

SEQ ID NO: 2398 - RNA, 19 nt, Artificial Sequence
  source: /note="Description of Artificial Sequence: Synthetic oligonucleotide"
cuuauauucaguuuacaua

SEQ ID NO: 2399 - RNA, 19 nt, Artificial Sequence
  source: /note="Description of Artificial Sequence: Synthetic oligonucleotide"
uuacauaaaggccccaaau

SEQ ID NO: 2400 - RNA, 19 nt, Artificial Sequence
  source: /note="Description of Artificial Sequence: Synthetic oligonucleotide"
auaccaugucagaucuuuu

SEQ ID NO: 2401 - RNA, 19 nt, Artificial Sequence
  source: /note="Description of Artificial Sequence: Synthetic oligonucleotide"
aaaagaguuaaugaacuau

SEQ ID NO: 2402 - RNA, 19 nt, Artificial Sequence
  source: /note="Description of Artificial Sequence: Synthetic oligonucleotide"
augagaauugggauuacau

SEQ ID NO: 2403 - RNA, 19 nt, Artificial Sequence
  source: /note="Description of Artificial Sequence: Synthetic oligonucleotide"
aucauguauuuugccucau

SEQ ID NO: 2404 - RNA, 19 nt, Artificial Sequence
  source: /note="Description of Artificial Sequence: Synthetic oligonucleotide"
uuaucacacuuauaggcca

SEQ ID NO: 2405 - RNA, 19 nt, Artificial Sequence
  source: /note="Description of Artificial Sequence: Synthetic oligonucleotide"
caagugugauaaauaaacu

SEQ ID NO: 2406 - RNA, 19 nt, Artificial Sequence
  source: /note="Description of Artificial Sequence: Synthetic oligonucleotide"
uuacagacacugaauuaau

SEQ ID NO: 2407 - RNA, 19 nt, Artificial Sequence
  source: /note="Description of Artificial Sequence: Synthetic oligonucleotide"
uuugaaaccagaaaauaau

SEQ ID NO: 2408 - RNA, 19 nt, Artificial Sequence
  source: /note="Description of Artificial Sequence: Synthetic oligonucleotide"
augacuggccauucguuaa

SEQ ID NO: 2409 - RNA, 19 nt, Artificial Sequence
  source: /note="Description of Artificial Sequence: Synthetic oligonucleotide"
uuaguugaaaagcauauuu

SEQ ID NO: 2410 - RNA, 19 nt, Artificial Sequence
  source: /note="Description of Artificial Sequence: Synthetic oligonucleotide"
uuuuuauuaaauuaauucu

SEQ ID NO: 2411 - RNA, 19 nt, Artificial Sequence
  source: /note="Description of Artificial Sequence: Synthetic oligonucleotide"
cugauuguauuugaaauua

SEQ ID NO: 2412 - RNA, 19 nt, Artificial Sequence
  source: /note="Description of Artificial Sequence: Synthetic oligonucleotide"
uuugaaauuauuauucaau

SEQ ID NO: 2413 - RNA, 19 nt, Artificial Sequence
  source: /note="Description of Artificial Sequence: Synthetic oligonucleotide"
uuauggcagaggaauauca

SEQ ID NO: 2414 - RNA, 19 nt, Artificial Sequence
  source: /note="Description of Artificial Sequence: Synthetic oligonucleotide"
ucuaaaaauguaacuaauu

SEQ ID NO: 2415 - RNA, 19 nt, Artificial Sequence
  source: /note="Description of Artificial Sequence: Synthetic oligonucleotide"
uuuacuguuuaauaagcau

SEQ ID NO: 2416 - RNA, 19 nt, Artificial Sequence
  source: /note="Description of Artificial Sequence: Synthetic oligonucleotide"
ugucauaauaaaaugguau

SEQ ID NO: 2417 - RNA, 19 nt, Artificial Sequence
  source: /note="Description of Artificial Sequence: Synthetic oligonucleotide"
auaucuuucuuuaguaauu

SEQ ID NO: 2418 - RNA, 19 nt, Artificial Sequence
  source: /note="Description of Artificial Sequence: Synthetic oligonucleotide"
uuaguaauuacauuaaaau

SEQ ID NO: 2419 - RNA, 19 nt, Artificial Sequence
  source: /note="Description of Artificial Sequence: Synthetic oligonucleotide"
auuagucauguuugauuaa

SEQ ID NO: 2420 - RNA, 19 nt, Artificial Sequence
  source: /note="Description of Artificial Sequence: Synthetic oligonucleotide"
aaauccucacauuuaucua

SEQ ID NO: 2421 - RNA, 19 nt, Artificial Sequence
  source: /note="Description of Artificial Sequence: Synthetic oligonucleotide"
agaagagggauuuagagaa

SEQ ID NO: 2422 - RNA, 19 nt, Artificial Sequence
  source: /note="Description of Artificial Sequence: Synthetic oligonucleotide"
agugagauuuagcaaacag

SEQ ID NO: 2423 - RNA, 19 nt, Artificial Sequence
  source: /note="Description of Artificial Sequence: Synthetic oligonucleotide"
auuuagcagugacagugag

SEQ ID NO: 2424 - RNA, 19 nt, Artificial Sequence
  source: /note="Description of Artificial Sequence: Synthetic oligonucleotide"
aggcucuaucugcucugaa

SEQ ID NO: 2425 - RNA, 19 nt, Artificial Sequence
  source: /note="Description of Artificial Sequence: Synthetic oligonucleotide"
ugagauguugagagcaaug

SEQ ID NO: 2426 - RNA, 19 nt, Artificial Sequence
  source: /note="Description of Artificial Sequence: Synthetic oligonucleotide"
agucugaaaaugaauuggu

SEQ ID NO: 2427 - RNA, 19 nt, Artificial Sequence
  source: /note="Description of Artificial Sequence: Synthetic oligonucleotide"
auugcuucugaaguacaaa

SEQ ID NO: 2428 - RNA, 19 nt, Artificial Sequence
  source: /note="Description of Artificial Sequence: Synthetic oligonucleotide"
uacugcugauuuuucccau

SEQ ID NO: 2429 - RNA, 19 nt, Artificial Sequence
  source: /note="Description of Artificial Sequence: Synthetic oligonucleotide"
agcagcacuuaaauaauug

SEQ ID NO: 2430 - RNA, 19 nt, Artificial Sequence
  source: /note="Description of Artificial Sequence: Synthetic oligonucleotide"
ugugcaucuucaccuucaa

SEQ ID NO: 2431 - RNA, 19 nt, Artificial Sequence
  source: /note="Description of Artificial Sequence: Synthetic oligonucleotide"
ugggcuuguugaaauaaaa

SEQ ID NO: 2432 - RNA, 19 nt, Artificial Sequence
  source: /note="Description of Artificial Sequence: Synthetic oligonucleotide"
ucuggagccauacccugug

SEQ ID NO: 2433 - RNA, 19 nt, Artificial Sequence
  source: /note="Description of Artificial Sequence: Synthetic oligonucleotide"
aggcgcccuccgacugcug

SEQ ID NO: 2434 - RNA, 19 nt, Artificial Sequence
  source: /note="Description of Artificial Sequence: Synthetic oligonucleotide"
aggcuugaggggugcgcaa

SEQ ID NO: 2435 - RNA, 19 nt, Artificial Sequence
  source: /note="Description of Artificial Sequence: Synthetic oligonucleotide"
uuaguucuuguuuccugca

SEQ ID NO: 2436 - RNA, 19 nt, Artificial Sequence
  source: /note="Description of Artificial Sequence: Synthetic oligonucleotide"
agggucuuccuacauccug

SEQ ID NO: 2437 - RNA, 19 nt, Artificial Sequence
  source: /note="Description of Artificial Sequence: Synthetic oligonucleotide"
uagguguuccaaaguuuaa

SEQ ID NO: 2438 - RNA, 19 nt, Artificial Sequence
  source: /note="Description of Artificial Sequence: Synthetic oligonucleotide"
aauguuaucaaacuuauuu

SEQ ID NO: 2439 - RNA, 19 nt, Artificial Sequence
  source: /note="Description of Artificial Sequence: Synthetic oligonucleotide"
ugaaacgcccaucuuuuaa

SEQ ID NO: 2440 - RNA, 19 nt, Artificial Sequence
  source: /note="Description of Artificial Sequence: Synthetic oligonucleotide"
aauguuuacuuguguauuu

SEQ ID NO: 2441 - RNA, 19 nt, Artificial Sequence
  source: /note="Description of Artificial Sequence: Synthetic oligonucleotide"
ucuaaagacaauguuggaa

SEQ ID NO: 2442 - RNA, 19 nt, Artificial Sequence
  source: /note="Description of Artificial Sequence: Synthetic oligonucleotide"
ucaaggugcaaaucacucc

SEQ ID NO: 2443 - RNA, 19 nt, Artificial Sequence
  source: /note="Description of Artificial Sequence: Synthetic oligonucleotide"
auaaaagaucaacagcaau

SEQ ID NO: 2444 - RNA, 19 nt, Artificial Sequence
  source: /note="Description of Artificial Sequence: Synthetic oligonucleotide"
uucuauagaacauuauuga

SEQ ID NO: 2445 - RNA, 19 nt, Artificial Sequence
  source: /note="Description of Artificial Sequence: Synthetic oligonucleotide"
auauauuuuuuuuuucuuu

SEQ ID NO: 2446 - RNA, 19 nt, Artificial Sequence
  source: /note="Description of Artificial Sequence: Synthetic oligonucleotide"
uuaagauauauauauauau

SEQ ID NO: 2447 - RNA, 19 nt, Artificial Sequence
  source: /note="Description of Artificial Sequence: Synthetic oligonucleotide"
agaagugcaaauaaggaaa

SEQ ID NO: 2448 - RNA, 19 nt, Artificial Sequence
  source: /note="Description of Artificial Sequence: Synthetic oligonucleotide"
ucccgaguuguguagaaag

SEQ ID NO: 2449 - RNA, 19 nt, Artificial Sequence
  source: /note="Description of Artificial Sequence: Synthetic oligonucleotide"
acacuguaaaacaaacagc

SEQ ID NO: 2450 - RNA, 19 nt, Artificial Sequence
  source: /note="Description of Artificial Sequence: Synthetic oligonucleotide"
agauuaucagacacuguaa

SEQ ID NO: 2451 - RNA, 19 nt, Artificial Sequence
  source: /note="Description of Artificial Sequence: Synthetic oligonucleotide"
agacuaacaagauuaucag

SEQ ID NO: 2452 - RNA, 19 nt, Artificial Sequence
  source: /note="Description of Artificial Sequence: Synthetic oligonucleotide"
aagggaggugguggguaua

SEQ ID NO: 2453 - RNA, 19 nt, Artificial Sequence
  source: /note="Description of Artificial Sequence: Synthetic oligonucleotide"
aggaggccaaauucggcaa

SEQ ID NO: 2454 - RNA, 19 nt, Artificial Sequence
  source: /note="Description of Artificial Sequence: Synthetic oligonucleotide"
ugaggaggccaaauucggc

SEQ ID NO: 2455 - RNA, 19 nt, Artificial Sequence
  source: /note="Description of Artificial Sequence: Synthetic oligonucleotide"
acgacuugcugcugcuuuu

SEQ ID NO: 2456 - RNA, 19 nt, Artificial Sequence
  source: /note="Description of Artificial Sequence: Synthetic oligonucleotide"
aauuggugugcuucuugac

SEQ ID NO: 2457 - RNA, 19 nt, Artificial Sequence
  source: /note="Description of Artificial Sequence: Synthetic oligonucleotide"
aaauaaaaugcauccaacu

SEQ ID NO: 2458 - RNA, 19 nt, Artificial Sequence
  source: /note="Description of Artificial Sequence: Synthetic oligonucleotide"
aauaaagcuuugugucuaa

SEQ ID NO: 2459 - RNA, 19 nt, Artificial Sequence
  source: /note="Description of Artificial Sequence: Synthetic oligonucleotide"
uuuuuguaagcaugaugug

SEQ ID NO: 2460 - RNA, 19 nt, Artificial Sequence
  source: /note="Description of Artificial Sequence: Synthetic oligonucleotide"
aacuauuugcauuauucuu

SEQ ID NO: 2461 - RNA, 19 nt, Artificial Sequence
  source: /note="Description of Artificial Sequence: Synthetic oligonucleotide"
uauuggccucaaaguugca

SEQ ID NO: 2462 - RNA, 19 nt, Artificial Sequence
  source: /note="Description of Artificial Sequence: Synthetic oligonucleotide"
aaacauaugccuaaaaaug

SEQ ID NO: 2463 - RNA, 19 nt, Artificial Sequence
  source: /note="Description of Artificial Sequence: Synthetic oligonucleotide"
agaaacuuucuauguuuaa

SEQ ID NO: 2464 - RNA, 19 nt, Artificial Sequence
  source: /note="Description of Artificial Sequence: Synthetic oligonucleotide"
uaacucuuuugaguugaag

SEQ ID NO: 2465 - RNA, 19 nt, Artificial Sequence
  source: /note="Description of Artificial Sequence: Synthetic oligonucleotide"
uaacucaucauuugaagga

SEQ ID NO: 2466 - RNA, 19 nt, Artificial Sequence
  source: /note="Description of Artificial Sequence: Synthetic oligonucleotide"
aaaagaggaaaguuacuaa

SEQ ID NO: 2467 - RNA, 19 nt, Artificial Sequence
  source: /note="Description of Artificial Sequence: Synthetic oligonucleotide"
agugcucuauauggaaaaa

SEQ ID NO: 2468 - RNA, 19 nt, Artificial Sequence
  source: /note="Description of Artificial Sequence: Synthetic oligonucleotide"
auaugcuaaauuuacauag

SEQ ID NO: 2469 - RNA, 19 nt, Artificial Sequence
  source: /note="Description of Artificial Sequence: Synthetic oligonucleotide"
uauauccuguauaauugau

SEQ ID NO: 2470 - RNA, 19 nt, Artificial Sequence
  source: /note="Description of Artificial Sequence: Synthetic oligonucleotide"
auagcaccauuauacuaaa

SEQ ID NO: 2471 - RNA, 19 nt, Artificial Sequence
  source: /note="Description of Artificial Sequence: Synthetic oligonucleotide"
agacucuuucauauaacaa

SEQ ID NO: 2472 - RNA, 19 nt, Artificial Sequence
  source: /note="Description of Artificial Sequence: Synthetic oligonucleotide"
ugcuuucacguauuaccgu

SEQ ID NO: 2473 - RNA, 19 nt, Artificial Sequence
  source: /note="Description of Artificial Sequence: Synthetic oligonucleotide"
aggcuuccccuauuguuuu

SEQ ID NO: 2474 - RNA, 19 nt, Artificial Sequence
  source: /note="Description of Artificial Sequence: Synthetic oligonucleotide"
auggaugguguuuucagua

SEQ ID NO: 2475 - RNA, 19 nt, Artificial Sequence
  source: /note="Description of Artificial Sequence: Synthetic oligonucleotide"
acuuugccuucuuucccaa

SEQ ID NO: 2476 - RNA, 19 nt, Artificial Sequence
  source: /note="Description of Artificial Sequence: Synthetic oligonucleotide"
aguggacuuuugugucuga

SEQ ID NO: 2477 - RNA, 19 nt, Artificial Sequence
  source: /note="Description of Artificial Sequence: Synthetic oligonucleotide"
aguuuccucucuggacucg

SEQ ID NO: 2478 - RNA, 19 nt, Artificial Sequence
  source: /note="Description of Artificial Sequence: Synthetic oligonucleotide"
uuuuuccauuccacaguuu

SEQ ID NO: 2479 - RNA, 19 nt, Artificial Sequence
  source: /note="Description of Artificial Sequence: Synthetic oligonucleotide"
aaauuccuagccuucugcu

SEQ ID NO: 2480 - RNA, 19 nt, Artificial Sequence
  source: /note="Description of Artificial Sequence: Synthetic oligonucleotide"
aagaaaccaggacugcuaa

SEQ ID NO: 2481 - RNA, 19 nt, Artificial Sequence
  source: /note="Description of Artificial Sequence: Synthetic oligonucleotide"
acauauugcccccauuuug

SEQ ID NO: 2482 - RNA, 19 nt, Artificial Sequence
  source: /note="Description of Artificial Sequence: Synthetic oligonucleotide"
uaaucuuuaucuuuuuaaa

SEQ ID NO: 2483 - RNA, 19 nt, Artificial Sequence
  source: /note="Description of Artificial Sequence: Synthetic oligonucleotide"
uaggguaaaaaaaaucuga

SEQ ID NO: 2484 - RNA, 19 nt, Artificial Sequence
  source: /note="Description of Artificial Sequence: Synthetic oligonucleotide"
agcaacccaggguaaaaaa

SEQ ID NO: 2485 - RNA, 19 nt, Artificial Sequence
  source: /note="Description of Artificial Sequence: Synthetic oligonucleotide"
ugauguugcacccuuacag

SEQ ID NO: 2486 - RNA, 19 nt, Artificial Sequence
  source: /note="Description of Artificial Sequence: Synthetic oligonucleotide"
agaauuccuugcaucucag

SEQ ID NO: 2487 - RNA, 19 nt, Artificial Sequence
  source: /note="Description of Artificial Sequence: Synthetic oligonucleotide"
ugagcauucaauucaccaa

SEQ ID NO: 2488 - RNA, 19 nt, Artificial Sequence
  source: /note="Description of Artificial Sequence: Synthetic oligonucleotide"
auagcuucacugacaagaa

SEQ ID NO: 2489 - RNA, 19 nt, Artificial Sequence
  source: /note="Description of Artificial Sequence: Synthetic oligonucleotide"
aacuaguuggccaguuauu

SEQ ID NO: 2490 - RNA, 19 nt, Artificial Sequence
  source: /note="Description of Artificial Sequence: Synthetic oligonucleotide"
uagcuguuagcuuuuaaca

SEQ ID NO: 2491 - RNA, 19 nt, Artificial Sequence
  source: /note="Description of Artificial Sequence: Synthetic oligonucleotide"
aaaguguuuuaagagauug

SEQ ID NO: 2492 - RNA, 19 nt, Artificial Sequence
  source: /note="Description of Artificial Sequence: Synthetic oligonucleotide"
aaugcuucccacauauuuu

SEQ ID NO: 2493 - RNA, 19 nt, Artificial Sequence
  source: /note="Description of Artificial Sequence: Synthetic oligonucleotide"
aaucaaauugaaaaucaaa

SEQ ID NO: 2494 - RNA, 19 nt, Artificial Sequence
  source: /note="Description of Artificial Sequence: Synthetic oligonucleotide"
aaccaaaugcagaauucaa

SEQ ID NO: 2495 - RNA, 19 nt, Artificial Sequence
  source: /note="Description of Artificial Sequence: Synthetic oligonucleotide"
uuaucuuuguauucauaaa

SEQ ID NO: 2496 - RNA, 19 nt, Artificial Sequence
  source: /note="Description of Artificial Sequence: Synthetic oligonucleotide"
uuccuuucucucuuuucac

SEQ ID NO: 2497 - RNA, 19 nt, Artificial Sequence
  source: /note="Description of Artificial Sequence: Synthetic oligonucleotide"
guuuuucuccuuuuucuuu

SEQ ID NO: 2498 - RNA, 19 nt, Artificial Sequence
  source: /note="Description of Artificial Sequence: Synthetic oligonucleotide"
uugguagaaaucucuuugu

SEQ ID NO: 2499 - RNA, 19 nt, Artificial Sequence
  source: /note="Description of Artificial Sequence: Synthetic oligonucleotide"
agucagugagugcuaacaa

SEQ ID NO: 2500 - RNA, 19 nt, Artificial Sequence
  source: /note="Description of Artificial Sequence: Synthetic oligonucleotide"
agguuuuacuagauaugua

SEQ ID NO: 2501 - RNA, 19 nt, Artificial Sequence
  source: /note="Description of Artificial Sequence: Synthetic oligonucleotide"
auuuauaguauuaaacgag

SEQ ID NO: 2502 - RNA, 19 nt, Artificial Sequence
  source: /note="Description of Artificial Sequence: Synthetic oligonucleotide"
uauuauuuauaguauuaaa

SEQ ID NO: 2503 - RNA, 19 nt, Artificial Sequence
  source: /note="Description of Artificial Sequence: Synthetic oligonucleotide"
uuucaaaaugaauagaaua

SEQ ID NO: 2504 - RNA, 19 nt, Artificial Sequence
  source: /note="Description of Artificial Sequence: Synthetic oligonucleotide"
aaucauuguguuuuucaaa

SEQ ID NO: 2505 - RNA, 19 nt, Artificial Sequence
  source: /note="Description of Artificial Sequence: Synthetic oligonucleotide"
auuuuggaucacuuuccuu

SEQ ID NO: 2506 - RNA, 19 nt, Artificial Sequence
  source: /note="Description of Artificial Sequence: Synthetic oligonucleotide"
auuauuuuaauauuucaaa

SEQ ID NO: 2507 - RNA, 19 nt, Artificial Sequence
  source: /note="Description of Artificial Sequence: Synthetic oligonucleotide"
uuauuagauauuauuuuaa

SEQ ID NO: 2508 - RNA, 19 nt, Artificial Sequence
  source: /note="Description of Artificial Sequence: Synthetic oligonucleotide"
agauaacuuugugacuuuu

SEQ ID NO: 2509 - RNA, 19 nt, Artificial Sequence
  source: /note="Description of Artificial Sequence: Synthetic oligonucleotide"
aguaaaguuuguuaaagaa

SEQ ID NO: 2510 - RNA, 19 nt, Artificial Sequence
  source: /note="Description of Artificial Sequence: Synthetic oligonucleotide"
auacagcuaagaauaagag

SEQ ID NO: 2511 - RNA, 19 nt, Artificial Sequence
  source: /note="Description of Artificial Sequence: Synthetic oligonucleotide"
cuuuuaaaaaaauguauau

SEQ ID NO: 2512 - RNA, 19 nt, Artificial Sequence
  source: /note="Description of Artificial Sequence: Synthetic oligonucleotide"
acaaacuuuuaaaaaaaug

SEQ ID NO: 2513 - RNA, 19 nt, Artificial Sequence
  source: /note="Description of Artificial Sequence: Synthetic oligonucleotide"
uagucaagcauauuuuaac

SEQ ID NO: 2514 - RNA, 19 nt, Artificial Sequence
  source: /note="Description of Artificial Sequence: Synthetic oligonucleotide"
ugaaacucuagucaagcau

SEQ ID NO: 2515 - RNA, 19 nt, Artificial Sequence
  source: /note="Description of Artificial Sequence: Synthetic oligonucleotide"
aguuuuugccuuucaacug

SEQ ID NO: 2516 - RNA, 19 nt, Artificial Sequence
  source: /note="Description of Artificial Sequence: Synthetic oligonucleotide"
auuucuuguugugauggaa

SEQ ID NO: 2517 - RNA, 19 nt, Artificial Sequence
  source: /note="Description of Artificial Sequence: Synthetic oligonucleotide"
uggacuuucuugauaccaa

SEQ ID NO: 2518 - RNA, 19 nt, Artificial Sequence
  source: /note="Description of Artificial Sequence: Synthetic oligonucleotide"
uauggacuaguacacuaac

SEQ ID NO: 2519 - RNA, 19 nt, Artificial Sequence
  source: /note="Description of Artificial Sequence: Synthetic oligonucleotide"
uaucauuuucuaggcuaug

SEQ ID NO: 2520 - RNA, 19 nt, Artificial Sequence
  source: /note="Description of Artificial Sequence: Synthetic oligonucleotide"
uuugaucugcagauaggga

SEQ ID NO: 2521 - RNA, 19 nt, Artificial Sequence
  source: /note="Description of Artificial Sequence: Synthetic oligonucleotide"
agaucugaaugcuggauaa

SEQ ID NO: 2522 - RNA, 19 nt, Artificial Sequence
  source: /note="Description of Artificial Sequence: Synthetic oligonucleotide"
ugguacuuuuaaccaaaaa

SEQ ID NO: 2523 - RNA, 19 nt, Artificial Sequence
  source: /note="Description of Artificial Sequence: Synthetic oligonucleotide"
aaauaaucaagccugggua

SEQ ID NO: 2524 - RNA, 19 nt, Artificial Sequence
  source: /note="Description of Artificial Sequence: Synthetic oligonucleotide"
aaauauagaauuugcauga

SEQ ID NO: 2525 - RNA, 19 nt, Artificial Sequence
  source: /note="Description of Artificial Sequence: Synthetic oligonucleotide"
agacuuuccaagaauguaa

SEQ ID NO: 2526 - RNA, 19 nt, Artificial Sequence
  source: /note="Description of Artificial Sequence: Synthetic oligonucleotide"
ucauauagacuuuccaaga

SEQ ID NO: 2527 - RNA, 19 nt, Artificial Sequence
  source: /note="Description of Artificial Sequence: Synthetic oligonucleotide"
agauguuauuuuuguuuuu

SEQ ID NO: 2528 - RNA, 19 nt, Artificial Sequence
  source: /note="Description of Artificial Sequence: Synthetic oligonucleotide"
aggugacccagugggagaa

SEQ ID NO: 2529 - RNA, 19 nt, Artificial Sequence
  source: /note="Description of Artificial Sequence: Synthetic oligonucleotide"
uccuggccucugauccuug

SEQ ID NO: 2530 - RNA, 19 nt, Artificial Sequence
  source: /note="Description of Artificial Sequence: Synthetic oligonucleotide"
uagucuuuuuuuuuuuuuu

SEQ ID NO: 2531 - RNA, 19 nt, Artificial Sequence
  source: /note="Description of Artificial Sequence: Synthetic oligonucleotide"
auauucagagauccaggga

SEQ ID NO: 2532 - RNA, 19 nt, Artificial Sequence
  source: /note="Description of Artificial Sequence: Synthetic oligonucleotide"
uggccuucuuuuugcauau

SEQ ID NO: 2533 - RNA, 19 nt, Artificial Sequence
  source: /note="Description of Artificial Sequence: Synthetic oligonucleotide"
aggauugcuggcuccacua

SEQ ID NO: 2534 - RNA, 19 nt, Artificial Sequence
  source: /note="Description of Artificial Sequence: Synthetic oligonucleotide"
auguuggacugagaguuaa

SEQ ID NO: 2535 - RNA, 19 nt, Artificial Sequence
  source: /note="Description of Artificial Sequence: Synthetic oligonucleotide"
aggugcucaauucaaauaa

SEQ ID NO: 2536 - RNA, 19 nt, Artificial Sequence
  source: /note="Description of Artificial Sequence: Synthetic oligonucleotide"
auaguuucuuuuacaucug

SEQ ID NO: 2537 - RNA, 19 nt, Artificial Sequence
  source: /note="Description of Artificial Sequence: Synthetic oligonucleotide"
uagggcaaaaaugauguau

SEQ ID NO: 2538 - RNA, 19 nt, Artificial Sequence
  source: /note="Description of Artificial Sequence: Synthetic oligonucleotide"
aaacaggcagagggcaaaa

SEQ ID NO: 2539 - RNA, 19 nt, Artificial Sequence
  source: /note="Description of Artificial Sequence: Synthetic oligonucleotide"
agaaccuguaugucuggaa

SEQ ID NO: 2540 - RNA, 19 nt, Artificial Sequence
  source: /note="Description of Artificial Sequence: Synthetic oligonucleotide"
ucaguaucuuauuccacag

SEQ ID NO: 2541 - RNA, 19 nt, Artificial Sequence
  source: /note="Description of Artificial Sequence: Synthetic oligonucleotide"
agaggaguccaguaucuua

SEQ ID NO: 2542 - RNA, 19 nt, Artificial Sequence
  source: /note="Description of Artificial Sequence: Synthetic oligonucleotide"
uaagugccaucuugggaag

SEQ ID NO: 2543 - RNA, 19 nt, Artificial Sequence
  source: /note="Description of Artificial Sequence: Synthetic oligonucleotide"
auaauuuuaaaagguacac

SEQ ID NO: 2544 - RNA, 19 nt, Artificial Sequence
  source: /note="Description of Artificial Sequence: Synthetic oligonucleotide"
aaguuuuguugagagggaa

SEQ ID NO: 2545 - RNA, 19 nt, Artificial Sequence
  source: /note="Description of Artificial Sequence: Synthetic oligonucleotide"
ucagaagacugccuauaaa

SEQ ID NO: 2546 - RNA, 19 nt, Artificial Sequence
  source: /note="Description of Artificial Sequence: Synthetic oligonucleotide"
aucuaacuaugacagaaaa

SEQ ID NO: 2547 - RNA, 19 nt, Artificial Sequence
  source: /note="Description of Artificial Sequence: Synthetic oligonucleotide"
acucuuagaauuaucacau

SEQ ID NO: 2548 - RNA, 19 nt, Artificial Sequence
  source: /note="Description of Artificial Sequence: Synthetic oligonucleotide"
auagaauuaagugaaggaa

SEQ ID NO: 2549 - RNA, 19 nt, Artificial Sequence
  source: /note="Description of Artificial Sequence: Synthetic oligonucleotide"
aaaaguuaagaaagauaau

SEQ ID NO: 2550 - RNA, 19 nt, Artificial Sequence
  source: /note="Description of Artificial Sequence: Synthetic oligonucleotide"
agaggauuauguguuggaa

SEQ ID NO: 2551 - RNA, 19 nt, Artificial Sequence
  source: /note="Description of Artificial Sequence: Synthetic oligonucleotide"
aguuauuuucaauuuauuu

SEQ ID NO: 2552 - RNA, 19 nt, Artificial Sequence
  source: /note="Description of Artificial Sequence: Synthetic oligonucleotide"
uagugaauugguauaauga

SEQ ID NO: 2553 - RNA, 19 nt, Artificial Sequence
  source: /note="Description of Artificial Sequence: Synthetic oligonucleotide"
auucauuaaaaaauaaaau

SEQ ID NO: 2554 - RNA, 19 nt, Artificial Sequence
  source: /note="Description of Artificial Sequence: Synthetic oligonucleotide"
auuuguuuucuaguuuuaa

SEQ ID NO: 2555 - RNA, 19 nt, Artificial Sequence
  source: /note="Description of Artificial Sequence: Synthetic oligonucleotide"
uguaguauauaguaaucaa

SEQ ID NO: 2556 - RNA, 19 nt, Artificial Sequence
  source: /note="Description of Artificial Sequence: Synthetic oligonucleotide"
ucuaugaaaucugagucau

SEQ ID NO: 2557 - RNA, 19 nt, Artificial Sequence
  source: /note="Description of Artificial Sequence: Synthetic oligonucleotide"
acauuuugguugcuccuuu

SEQ ID NO: 2558 - RNA, 19 nt, Artificial Sequence
  source: /note="Description of Artificial Sequence: Synthetic oligonucleotide"
uaaaguuuuggguugugac

SEQ ID NO: 2559 - RNA, 19 nt, Artificial Sequence
  source: /note="Description of Artificial Sequence: Synthetic oligonucleotide"
agcaaagcuuguaaaguuu

SEQ ID NO: 2560 - RNA, 19 nt, Artificial Sequence
  source: /note="Description of Artificial Sequence: Synthetic oligonucleotide"
aaagcaaucuaauucugaa

SEQ ID NO: 2561 - RNA, 19 nt, Artificial Sequence
  source: /note="Description of Artificial Sequence: Synthetic oligonucleotide"
ucucauucaagaauuauaa

SEQ ID NO: 2562 - RNA, 19 nt, Artificial Sequence
  source: /note="Description of Artificial Sequence: Synthetic oligonucleotide"
uugccucauucaagaauua

SEQ ID NO: 2563 - RNA, 19 nt, Artificial Sequence
  source: /note="Description of Artificial Sequence: Synthetic oligonucleotide"
uuuacaaauaucuugaaau

SEQ ID NO: 2564 - RNA, 19 nt, Artificial Sequence
  source: /note="Description of Artificial Sequence: Synthetic oligonucleotide"
accaauguuuacuguucuu

SEQ ID NO: 2565 - RNA, 19 nt, Artificial Sequence
  source: /note="Description of Artificial Sequence: Synthetic oligonucleotide"
auaagccuaugaguugaaa

SEQ ID NO: 2566 - RNA, 19 nt, Artificial Sequence
  source: /note="Description of Artificial Sequence: Synthetic oligonucleotide"
aaguauccaguauggucaa

SEQ ID NO: 2567 - RNA, 19 nt, Artificial Sequence
  source: /note="Description of Artificial Sequence: Synthetic oligonucleotide"
ugaacugccucaucuuaaa

SEQ ID NO: 2568 - RNA, 19 nt, Artificial Sequence
  source: /note="Description of Artificial Sequence: Synthetic oligonucleotide"
agaagaguggauucugaug

SEQ ID NO: 2569 - RNA, 19 nt, Artificial Sequence
  source: /note="Description of Artificial Sequence: Synthetic oligonucleotide"
agagauuuucauaucccua

SEQ ID NO: 2570 - RNA, 19 nt, Artificial Sequence
  source: /note="Description of Artificial Sequence: Synthetic oligonucleotide"
auuggauccuuagggugaa

SEQ ID NO: 2571 - RNA, 19 nt, Artificial Sequence
  source: /note="Description of Artificial Sequence: Synthetic oligonucleotide"
uuucuuuucaguauuccau

SEQ ID NO: 2572 - RNA, 19 nt, Artificial Sequence
  source: /note="Description of Artificial Sequence: Synthetic oligonucleotide"
ugauuucuuuucaguauuc

SEQ ID NO: 2573 - RNA, 19 nt, Artificial Sequence
  source: /note="Description of Artificial Sequence: Synthetic oligonucleotide"
auaaaauuuucaaggaagu

SEQ ID NO: 2574 - RNA, 19 nt, Artificial Sequence
  source: /note="Description of Artificial Sequence: Synthetic oligonucleotide"
uuguuuguuuguuuuuuaa

SEQ ID NO: 2575 - RNA, 19 nt, Artificial Sequence
  source: /note="Description of Artificial Sequence: Synthetic oligonucleotide"
uuggacaggcuuuuuguuu

SEQ ID NO: 2576 - RNA, 19 nt, Artificial Sequence
  source: /note="Description of Artificial Sequence: Synthetic oligonucleotide"
augguuucaucuacacaaa

SEQ ID NO: 2577 - RNA, 19 nt, Artificial Sequence
  source: /note="Description of Artificial Sequence: Synthetic oligonucleotide"
auucuaagccuucucccaa

SEQ ID NO: 2578 - RNA, 19 nt, Artificial Sequence
  source: /note="Description of Artificial Sequence: Synthetic oligonucleotide"
aaaugugcuacaucuuuua

SEQ ID NO: 2579 - RNA, 19 nt, Artificial Sequence
  source: /note="Description of Artificial Sequence: Synthetic oligonucleotide"
auagcuggccaaacaauaa

SEQ ID NO: 2580 - RNA, 19 nt, Artificial Sequence
  source: /note="Description of Artificial Sequence: Synthetic oligonucleotide"
aauagcaccacauuggcau

SEQ ID NO: 2581 - RNA, 19 nt, Artificial Sequence
  source: /note="Description of Artificial Sequence: Synthetic oligonucleotide"
uaaacaauagcaccacauu

SEQ ID NO: 2582 - RNA, 19 nt, Artificial Sequence
  source: /note="Description of Artificial Sequence: Synthetic oligonucleotide"
uucaaguacuuucuuaaag

SEQ ID NO: 2583 - RNA, 19 nt, Artificial Sequence
  source: /note="Description of Artificial Sequence: Synthetic oligonucleotide"
uuuuuucuuuuuuuuuuag

SEQ ID NO: 2584 - RNA, 19 nt, Artificial Sequence
  source: /note="Description of Artificial Sequence: Synthetic oligonucleotide"
augcuuucuuuuuuuucuu

SEQ ID NO: 2585 - RNA, 19 nt, Artificial Sequence
  source: /note="Description of Artificial Sequence: Synthetic oligonucleotide"
uuuaaaaaaauaugucuau

SEQ ID NO: 2586 - RNA, 19 nt, Artificial Sequence
  source: /note="Description of Artificial Sequence: Synthetic oligonucleotide"
uguuguuuuuauacuuuaa

SEQ ID NO: 2587 - RNA, 19 nt, Artificial Sequence
  source: /note="Description of Artificial Sequence: Synthetic oligonucleotide"
ucaucuaucuauagaauug

SEQ ID NO: 2588 - RNA, 19 nt, Artificial Sequence
  source: /note="Description of Artificial Sequence: Synthetic oligonucleotide"
aaugcuauuuuauuaagcc

SEQ ID NO: 2589 - RNA, 19 nt, Artificial Sequence
  source: /note="Description of Artificial Sequence: Synthetic oligonucleotide"
accuaaugcuauuuuauua

SEQ ID NO: 2590 - RNA, 19 nt, Artificial Sequence
  source: /note="Description of Artificial Sequence: Synthetic oligonucleotide"
agguggugguggcuagaua

SEQ ID NO: 2591 - RNA, 19 nt, Artificial Sequence
  source: /note="Description of Artificial Sequence: Synthetic oligonucleotide"
acuacuugugagugauaaa

SEQ ID NO: 2592 - RNA, 19 nt, Artificial Sequence
  source: /note="Description of Artificial Sequence: Synthetic oligonucleotide"
aaaauuuccaacuccugcc

SEQ ID NO: 2593 - RNA, 19 nt, Artificial Sequence
  source: /note="Description of Artificial Sequence: Synthetic oligonucleotide"
ugagccuucuaacuuuaaa

SEQ ID NO: 2594 - RNA, 19 nt, Artificial Sequence
  source: /note="Description of Artificial Sequence: Synthetic oligonucleotide"
agagccaacaaaacaaugg

SEQ ID NO: 2595 - RNA, 19 nt, Artificial Sequence
  source: /note="Description of Artificial Sequence: Synthetic oligonucleotide"
auauugcuaauuuugcuaa

SEQ ID NO: 2596 - RNA, 19 nt, Artificial Sequence
  source: /note="Description of Artificial Sequence: Synthetic oligonucleotide"
ucagaagauuggauaauau

SEQ ID NO: 2597 - RNA, 19 nt, Artificial Sequence
  source: /note="Description of Artificial Sequence: Synthetic oligonucleotide"
aguucagaagauuggauaa

SEQ ID NO: 2598 - RNA, 19 nt, Artificial Sequence
  source: /note="Description of Artificial Sequence: Synthetic oligonucleotide"
guuuauucuccaugcucuu

SEQ ID NO: 2599 - RNA, 19 nt, Artificial Sequence
  source: /note="Description of Artificial Sequence: Synthetic oligonucleotide"
aagaucuuuuuucccgcgu

SEQ ID NO: 2600 - RNA, 19 nt, Artificial Sequence
  source: /note="Description of Artificial Sequence: Synthetic oligonucleotide"
ucuauuugccuauaagauc

SEQ ID NO: 2601 - RNA, 19 nt, Artificial Sequence
  source: /note="Description of Artificial Sequence: Synthetic oligonucleotide"
acuuaucuuuuaaauucuu

SEQ ID NO: 2602 - RNA, 19 nt, Artificial Sequence
  source: /note="Description of Artificial Sequence: Synthetic oligonucleotide"
aaaucaauaaggaacuuac

SEQ ID NO: 2603 - RNA, 19 nt, Artificial Sequence
  source: /note="Description of Artificial Sequence: Synthetic oligonucleotide"
uagagcagagugcacaaaa

SEQ ID NO: 2604 - RNA, 19 nt, Artificial Sequence
  source: /note="Description of Artificial Sequence: Synthetic oligonucleotide"
acuugcugaauaucuguuu

SEQ ID NO: 2605 - RNA, 19 nt, Artificial Sequence
  source: /note="Description of Artificial Sequence: Synthetic oligonucleotide"
uauuuucuccacuugcuga

SEQ ID NO: 2606 - RNA, 19 nt, Artificial Sequence
  source: /note="Description of Artificial Sequence: Synthetic oligonucleotide"
auuuuuucucuuuguucuu

SEQ ID NO: 2607 - RNA, 19 nt, Artificial Sequence
  source: /note="Description of Artificial Sequence: Synthetic oligonucleotide"
ugcagguaaaucuauguau

SEQ ID NO: 2608 - RNA, 19 nt, Artificial Sequence
  source: /note="Description of Artificial Sequence: Synthetic oligonucleotide"
agcuauuuuuugcagguaa

SEQ ID NO: 2609 - RNA, 19 nt, Artificial Sequence
  source: /note="Description of Artificial Sequence: Synthetic oligonucleotide"
ugagaaugucuucuauaaa

SEQ ID NO: 2610 - RNA, 19 nt, Artificial Sequence
  source: /note="Description of Artificial Sequence: Synthetic oligonucleotide"
acugcucuuugagaugucu

SEQ ID NO: 2611 - RNA, 19 nt, Artificial Sequence
  source: /note="Description of Artificial Sequence: Synthetic oligonucleotide"
agauaacccccaucucaua

SEQ ID NO: 2612 - RNA, 19 nt, Artificial Sequence
  source: /note="Description of Artificial Sequence: Synthetic oligonucleotide"
auucuuucuuuaucaguag

SEQ ID NO: 2613 - RNA, 19 nt, Artificial Sequence
  source: /note="Description of Artificial Sequence: Synthetic oligonucleotide"
aauuucucauaaauucuuu

SEQ ID NO: 2614 - RNA, 19 nt, Artificial Sequence
  source: /note="Description of Artificial Sequence: Synthetic oligonucleotide"
aaaucuucacagauuguua

SEQ ID NO: 2615 - RNA, 19 nt, Artificial Sequence
  source: /note="Description of Artificial Sequence: Synthetic oligonucleotide"
aagacuguauaaaguaaaa

SEQ ID NO: 2616 - RNA, 19 nt, Artificial Sequence
  source: /note="Description of Artificial Sequence: Synthetic oligonucleotide"
acauuaagaaauucauaaa

SEQ ID NO: 2617 - RNA, 19 nt, Artificial Sequence
  source: /note="Description of Artificial Sequence: Synthetic oligonucleotide"
aagucauuuugaacauuaa

SEQ ID NO: 2618 - RNA, 19 nt, Artificial Sequence
  source: /note="Description of Artificial Sequence: Synthetic oligonucleotide"
ugauauaaaaaaagaagaa

SEQ ID NO: 2619 - RNA, 19 nt, Artificial Sequence
  source: /note="Description of Artificial Sequence: Synthetic oligonucleotide"
acuuauuauuccucauucu

SEQ ID NO: 2620 - RNA, 19 nt, Artificial Sequence
  source: /note="Description of Artificial Sequence: Synthetic oligonucleotide"
agagucuauguggguuuaa

SEQ ID NO: 2621 - RNA, 19 nt, Artificial Sequence
  source: /note="Description of Artificial Sequence: Synthetic oligonucleotide"
uuagccuauaguuuuaaag

SEQ ID NO: 2622 - RNA, 19 nt, Artificial Sequence
  source: /note="Description of Artificial Sequence: Synthetic oligonucleotide"
uaaacauacauuucuaucu

SEQ ID NO: 2623 - RNA, 19 nt, Artificial Sequence
  source: /note="Description of Artificial Sequence: Synthetic oligonucleotide"
auagcuucaacaagucaaa

SEQ ID NO: 2624 - RNA, 19 nt, Artificial Sequence
  source: /note="Description of Artificial Sequence: Synthetic oligonucleotide"
aaucuuuuaagauuaaaaa

SEQ ID NO: 2625 - RNA, 19 nt, Artificial Sequence
  source: /note="Description of Artificial Sequence: Synthetic oligonucleotide"
uucuaauaaauuagcacaa

SEQ ID NO: 2626 - RNA, 19 nt, Artificial Sequence
  source: /note="Description of Artificial Sequence: Synthetic oligonucleotide"
acagguucugcucuaauaa

SEQ ID NO: 2627 - RNA, 19 nt, Artificial Sequence
  source: /note="Description of Artificial Sequence: Synthetic oligonucleotide"
uuucugaggagagccaaac

SEQ ID NO: 2628 - RNA, 19 nt, Artificial Sequence
  source: /note="Description of Artificial Sequence: Synthetic oligonucleotide"
uuaucuuuugaaaauauug

SEQ ID NO: 2629 - RNA, 19 nt, Artificial Sequence
  source: /note="Description of Artificial Sequence: Synthetic oligonucleotide"
aaucagauuuaucuuuuga

SEQ ID NO: 2630 - RNA, 19 nt, Artificial Sequence
  source: /note="Description of Artificial Sequence: Synthetic oligonucleotide"
aaaugaugccauugcauaa

SEQ ID NO: 2631 - RNA, 19 nt, Artificial Sequence
  source: /note="Description of Artificial Sequence: Synthetic oligonucleotide"
aauaaaugaugccauugca

SEQ ID NO: 2632 - RNA, 19 nt, Artificial Sequence
  source: /note="Description of Artificial Sequence: Synthetic oligonucleotide"
acaauucuucuguuuuaaa

SEQ ID NO: 2633 - RNA, 19 nt, Artificial Sequence
  source: /note="Description of Artificial Sequence: Synthetic oligonucleotide"
acauuuuccuuuuguuguu

SEQ ID NO: 2634 - RNA, 19 nt, Artificial Sequence
  source: /note="Description of Artificial Sequence: Synthetic oligonucleotide"
auauguacuacaggauuaa

SEQ ID NO: 2635 - RNA, 19 nt, Artificial Sequence
  source: /note="Description of Artificial Sequence: Synthetic oligonucleotide"
ugucuuauaaaauauuaaa

SEQ ID NO: 2636 - RNA, 19 nt, Artificial Sequence
  source: /note="Description of Artificial Sequence: Synthetic oligonucleotide"
uuaauaccuaacaggaagg

SEQ ID NO: 2637 - RNA, 19 nt, Artificial Sequence
  source: /note="Description of Artificial Sequence: Synthetic oligonucleotide"
aucacuuucuaauaccuaa

SEQ ID NO: 2638 - RNA, 19 nt, Artificial Sequence
  source: /note="Description of Artificial Sequence: Synthetic oligonucleotide"
aaaaaagauaucuauguau

SEQ ID NO: 2639 - RNA, 19 nt, Artificial Sequence
  source: /note="Description of Artificial Sequence: Synthetic oligonucleotide"
aauagaaauuacacaaaaa

SEQ ID NO: 2640 - RNA, 19 nt, Artificial Sequence
  source: /note="Description of Artificial Sequence: Synthetic oligonucleotide"
agucuucucucuuuuuuaa

SEQ ID NO: 2641 - RNA, 19 nt, Artificial Sequence
  source: /note="Description of Artificial Sequence: Synthetic oligonucleotide"
uacuuaaagcuucugacag

SEQ ID NO: 2642 - RNA, 19 nt, Artificial Sequence
  source: /note="Description of Artificial Sequence: Synthetic oligonucleotide"
aucuuuauccuguaccaua

SEQ ID NO: 2643 - RNA, 19 nt, Artificial Sequence
  source: /note="Description of Artificial Sequence: Synthetic oligonucleotide"
auaggaauugguuauuuaa

SEQ ID NO: 2644 - RNA, 19 nt, Artificial Sequence
  source: /note="Description of Artificial Sequence: Synthetic oligonucleotide"
agguuucuuuaaaaaacaa

SEQ ID NO: 2645 - RNA, 19 nt, Artificial Sequence
  source: /note="Description of Artificial Sequence: Synthetic oligonucleotide"
ucugucuuaucugugagag

SEQ ID NO: 2646 - RNA, 19 nt, Artificial Sequence
  source: /note="Description of Artificial Sequence: Synthetic oligonucleotide"
agcccucuauaaaauucug

SEQ ID NO: 2647 - RNA, 19 nt, Artificial Sequence
  source: /note="Description of Artificial Sequence: Synthetic oligonucleotide"
agguuccuuuaauucuaga

SEQ ID NO: 2648 - RNA, 19 nt, Artificial Sequence
  source: /note="Description of Artificial Sequence: Synthetic oligonucleotide"
aauauauguuuucagugag

SEQ ID NO: 2649 - RNA, 19 nt, Artificial Sequence
  source: /note="Description of Artificial Sequence: Synthetic oligonucleotide"
acacgugaaauauauguuu

SEQ ID NO: 2650 - RNA, 19 nt, Artificial Sequence
  source: /note="Description of Artificial Sequence: Synthetic oligonucleotide"
aaaaaaaaaaagagggaac

SEQ ID NO: 2651 - RNA, 19 nt, Artificial Sequence
  source: /note="Description of Artificial Sequence: Synthetic oligonucleotide"
aggcaggagaaucgcuuaa

SEQ ID NO: 2652 - RNA, 19 nt, Artificial Sequence
  source: /note="Description of Artificial Sequence: Synthetic oligonucleotide"
aaauccaaaaaauuagccg

SEQ ID NO: 2653 - RNA, 19 nt, Artificial Sequence
  source: /note="Description of Artificial Sequence: Synthetic oligonucleotide"
aaaccccgucucuauuaaa

SEQ ID NO: 2654 - RNA, 19 nt, Artificial Sequence
  source: /note="Description of Artificial Sequence: Synthetic oligonucleotide"
accuggccaacaugguaaa

SEQ ID NO: 2655 - RNA, 19 nt, Artificial Sequence
  source: /note="Description of Artificial Sequence: Synthetic oligonucleotide"
augccuguaaucccagcaa

SEQ ID NO: 2656 - RNA, 19 nt, Artificial Sequence
  source: /note="Description of Artificial Sequence: Synthetic oligonucleotide"
agagaaggaucauguuuaa

SEQ ID NO: 2657 - RNA, 19 nt, Artificial Sequence
  source: /note="Description of Artificial Sequence: Synthetic oligonucleotide"
uuuccccuugaaagacccc

SEQ ID NO: 2658 - RNA, 19 nt, Artificial Sequence
  source: /note="Description of Artificial Sequence: Synthetic oligonucleotide"
uaaaaaagcuuggauuuuu

SEQ ID NO: 2659 - RNA, 19 nt, Artificial Sequence
  source: /note="Description of Artificial Sequence: Synthetic oligonucleotide"
cuuuuuuuuuuuuuacuuu

SEQ ID NO: 2660 - RNA, 19 nt, Artificial Sequence
  source: /note="Description of Artificial Sequence: Synthetic oligonucleotide"
uugguuuuguguccucucu

SEQ ID NO: 2661 - RNA, 19 nt, Artificial Sequence
  source: /note="Description of Artificial Sequence: Synthetic oligonucleotide"
aacucugucuccaucuuaa

SEQ ID NO: 2662 - RNA, 19 nt, Artificial Sequence
  source: /note="Description of Artificial Sequence: Synthetic oligonucleotide"
uuccgguuauuaggagaaa

SEQ ID NO: 2663 - RNA, 19 nt, Artificial Sequence
  source: /note="Description of Artificial Sequence: Synthetic oligonucleotide"
aagugaaagguaauucagc

SEQ ID NO: 2664 - RNA, 19 nt, Artificial Sequence
  source: /note="Description of Artificial Sequence: Synthetic oligonucleotide"
ugaaggucauguuuuugaa

SEQ ID NO: 2665 - RNA, 19 nt, Artificial Sequence
  source: /note="Description of Artificial Sequence: Synthetic oligonucleotide"
aggcagauucuaaggauug

SEQ ID NO: 2666 - RNA, 19 nt, Artificial Sequence
  source: /note="Description of Artificial Sequence: Synthetic oligonucleotide"
aggccucaguaauauaaaa

SEQ ID NO: 2667 - RNA, 19 nt, Artificial Sequence
  source: /note="Description of Artificial Sequence: Synthetic oligonucleotide"
augaguaauguuuacuuuu

SEQ ID NO: 2668 - RNA, 19 nt, Artificial Sequence
  source: /note="Description of Artificial Sequence: Synthetic oligonucleotide"
ucauuuugggcaaaauaaa

SEQ ID NO: 2669 - RNA, 19 nt, Artificial Sequence
  source: /note="Description of Artificial Sequence: Synthetic oligonucleotide"
uuccuacuuuacaucagug

SEQ ID NO: 2670 - RNA, 19 nt, Artificial Sequence
  source: /note="Description of Artificial Sequence: Synthetic oligonucleotide"
agagcucuguuuuuauuuu

SEQ ID NO: 2671 - RNA, 19 nt, Artificial Sequence
  source: /note="Description of Artificial Sequence: Synthetic oligonucleotide"
ugcuugaaagggauuuuag

SEQ ID NO: 2672 - RNA, 19 nt, Artificial Sequence
  source: /note="Description of Artificial Sequence: Synthetic oligonucleotide"
aguuggugaguggggucaa

SEQ ID NO: 2673 - RNA, 19 nt, Artificial Sequence
  source: /note="Description of Artificial Sequence: Synthetic oligonucleotide"
agcagcggguacaagauaa

SEQ ID NO: 2674 - RNA, 19 nt, Artificial Sequence
  source: /note="Description of Artificial Sequence: Synthetic oligonucleotide"
agacagcuugagguuucag

SEQ ID NO: 2675 - RNA, 19 nt, Artificial Sequence
  source: /note="Description of Artificial Sequence: Synthetic oligonucleotide"
auagacauuuucaugauac

SEQ ID NO: 2676 - RNA, 19 nt, Artificial Sequence
  source: /note="Description of Artificial Sequence: Synthetic oligonucleotide"
aagguuuugauauuuugaa

SEQ ID NO: 2677 - RNA, 19 nt, Artificial Sequence
  source: /note="Description of Artificial Sequence: Synthetic oligonucleotide"
agcugcgugauauuugaaa

SEQ ID NO: 2678 - RNA, 19 nt, Artificial Sequence
  source: /note="Description of Artificial Sequence: Synthetic oligonucleotide"
uauguaaacugaauauaag

SEQ ID NO: 2679 - RNA, 19 nt, Artificial Sequence
  source: /note="Description of Artificial Sequence: Synthetic oligonucleotide"
auuuggggccuuuauguaa

SEQ ID NO: 2680 - RNA, 19 nt, Artificial Sequence
  source: /note="Description of Artificial Sequence: Synthetic oligonucleotide"
aaaagaucugacaugguau

SEQ ID NO: 2681 - RNA, 19 nt, Artificial Sequence
  source: /note="Description of Artificial Sequence: Synthetic oligonucleotide"
auaguucauuaacucuuuu

SEQ ID NO: 2682 - RNA, 19 nt, Artificial Sequence
  source: /note="Description of Artificial Sequence: Synthetic oligonucleotide"
auguaaucccaauucucau

SEQ ID NO: 2683 - RNA, 19 nt, Artificial Sequence
  source: /note="Description of Artificial Sequence: Synthetic oligonucleotide"
augaggcaaaauacaugau

SEQ ID NO: 2684 - RNA, 19 nt, Artificial Sequence
  source: /note="Description of Artificial Sequence: Synthetic oligonucleotide"
uggccuauaagugugauaa

SEQ ID NO: 2685 - RNA, 19 nt, Artificial Sequence
  source: /note="Description of Artificial Sequence: Synthetic oligonucleotide"
aguuuauuuaucacacuug

SEQ ID NO: 2686 - RNA, 19 nt, Artificial Sequence
  source: /note="Description of Artificial Sequence: Synthetic oligonucleotide"
auuaauucagugucuguaa

SEQ ID NO: 2687 - RNA, 19 nt, Artificial Sequence
  source: /note="Description of Artificial Sequence: Synthetic oligonucleotide"
auuauuuucugguuucaaa

SEQ ID NO: 2688 - RNA, 19 nt, Artificial Sequence
  source: /note="Description of Artificial Sequence: Synthetic oligonucleotide"
uuaacgaauggccagucau

SEQ ID NO: 2689 - RNA, 19 nt, Artificial Sequence
  source: /note="Description of Artificial Sequence: Synthetic oligonucleotide"
aaauaugcuuuucaacuaa

SEQ ID NO: 2690 - RNA, 19 nt, Artificial Sequence
  source: /note="Description of Artificial Sequence: Synthetic oligonucleotide"
agaauuaauuuaauaaaaa

SEQ ID NO: 2691 - RNA, 19 nt, Artificial Sequence
  source: /note="Description of Artificial Sequence: Synthetic oligonucleotide"
uaauuucaaauacaaucag

SEQ ID NO: 2692 - RNA, 19 nt, Artificial Sequence
  source: /note="Description of Artificial Sequence: Synthetic oligonucleotide"
auugaauaauaauuucaaa

SEQ ID NO: 2693 - RNA, 19 nt, Artificial Sequence
  source: /note="Description of Artificial Sequence: Synthetic oligonucleotide"
ugauauuccucugccauaa

SEQ ID NO: 2694 - RNA, 19 nt, Artificial Sequence
  source: /note="Description of Artificial Sequence: Synthetic oligonucleotide"
aauuaguuacauuuuuaga

SEQ ID NO: 2695 - RNA, 19 nt, Artificial Sequence
  source: /note="Description of Artificial Sequence: Synthetic oligonucleotide"
augcuuauuaaacaguaaa

SEQ ID NO: 2696 - RNA, 19 nt, Artificial Sequence
  source: /note="Description of Artificial Sequence: Synthetic oligonucleotide"
auaccauuuuauuaugaca

SEQ ID NO: 2697 - RNA, 19 nt, Artificial Sequence
  source: /note="Description of Artificial Sequence: Synthetic oligonucleotide"
aauuacuaaagaaagauau

SEQ ID NO: 2698 - RNA, 19 nt, Artificial Sequence
  source: /note="Description of Artificial Sequence: Synthetic oligonucleotide"
auuuuaauguaauuacuaa

SEQ ID NO: 2699 - RNA, 19 nt, Artificial Sequence
  source: /note="Description of Artificial Sequence: Synthetic oligonucleotide"
uuaaucaaacaugacuaau

SEQ ID NO: 2700 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagauaaaugugaggauuutt

SEQ ID NO: 2701 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucuaaaucccucuucutt

SEQ ID NO: 2702 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguuugcuaaaucucacutt

SEQ ID NO: 2703 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucacugucacugcuaaautt

SEQ ID NO: 2704 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucagagcagauagagccutt

SEQ ID NO: 2705 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauugcucucaacaucucatt

SEQ ID NO: 2706 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaauucauuuucagacutt

SEQ ID NO: 2707 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuguacuucagaagcaautt

SEQ ID NO: 2708 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augggaaaaaucagcaguatt

SEQ ID NO: 2709 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caauuauuuaagugcugcutt

SEQ ID NO: 2710 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaaggugaagaugcacatt

SEQ ID NO: 2711 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuauuucaacaagcccatt

SEQ ID NO: 2712 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacaggguauggcuccagatt

SEQ ID NO: 2713 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcagucggagggcgccutt

SEQ ID NO: 2714 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcgcaccccucaagccutt

SEQ ID NO: 2715 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaggaaacaagaacuaatt

SEQ ID NO: 2716 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggauguaggaagacccutt

SEQ ID NO: 2717 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaacuuuggaacaccuatt

SEQ ID NO: 2718 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauaaguuugauaacauutt

SEQ ID NO: 2719 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaaagaugggcguuucatt

SEQ ID NO: 2720 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauacacaaguaaacauutt

SEQ ID NO: 2721 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccaacauugucuuuagatt

SEQ ID NO: 2722 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagugauuugcaccuugatt

SEQ ID NO: 2723 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugcuguugaucuuuuautt

SEQ ID NO: 2724 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaauaauguucuauagaatt

SEQ ID NO: 2725 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagaaaaaaaaaauauautt

SEQ ID NO: 2726 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauauauauauaucuuaatt

SEQ ID NO: 2727 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuccuuauuugcacuucutt

SEQ ID NO: 2728 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuucuacacaacucgggatt

SEQ ID NO: 2729 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuguuuguuuuacagugutt

SEQ ID NO: 2730 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacagugucugauaaucutt

SEQ ID NO: 2731 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugauaaucuuguuagucutt

SEQ ID NO: 2732 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauacccaccaccucccuutt

SEQ ID NO: 2733 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugccgaauuuggccuccutt

SEQ ID NO: 2734 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccgaauuuggccuccucatt

SEQ ID NO: 2735 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaagcagcagcaagucgutt

SEQ ID NO: 2736 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucaagaagcacaccaauutt

SEQ ID NO: 2737 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuggaugcauuuuauuutt

SEQ ID NO: 2738 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagacacaaagcuuuauutt

SEQ ID NO: 2739 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacaucaugcuuacaaaaatt

SEQ ID NO: 2740 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaauaaugcaaauaguutt

SEQ ID NO: 2741 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaacuuugaggccaauatt

SEQ ID NO: 2742 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuuuuaggcauauguuutt

SEQ ID NO: 2743 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaacauagaaaguuucutt

SEQ ID NO: 2744 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucaacucaaaagaguuatt

SEQ ID NO: 2745 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuucaaaugaugaguuatt

SEQ ID NO: 2746 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaguaacuuuccucuuuutt

SEQ ID NO: 2747 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuccauauagagcacutt

SEQ ID NO: 2748 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuauguaaauuuagcauautt

SEQ ID NO: 2749 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaauuauacaggauauatt

SEQ ID NO: 2750 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaguauaauggugcuautt

SEQ ID NO: 2751 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguuauaugaaagagucutt

SEQ ID NO: 2752 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgguaauacgugaaagcatt

SEQ ID NO: 2753 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaacaauaggggaagccutt

SEQ ID NO: 2754 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacugaaaacaccauccautt

SEQ ID NO: 2755 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugggaaagaaggcaaagutt

SEQ ID NO: 2756 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagacacaaaaguccacutt

SEQ ID NO: 2757 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaguccagagaggaaacutt

SEQ ID NO: 2758 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacuguggaauggaaaaatt

SEQ ID NO: 2759 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagaaggcuaggaauuutt

SEQ ID NO: 2760 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagcaguccugguuucuutt

SEQ ID NO: 2761 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaaaugggggcaauaugutt

SEQ ID NO: 2762 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaaaaagauaaagauuatt

SEQ ID NO: 2763 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagauuuuuuuuacccuatt

SEQ ID NO: 2764 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuuacccuggguugcutt

SEQ ID NO: 2765 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguaagggugcaacaucatt

SEQ ID NO: 2766 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugagaugcaaggaauucutt

SEQ ID NO: 2767 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggugaauugaaugcucatt

SEQ ID NO: 2768 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuugucagugaagcuautt

SEQ ID NO: 2769 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauaacuggccaacuaguutt

SEQ ID NO: 2770 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuaaaagcuaacagcuatt

SEQ ID NO: 2771 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaucucuuaaaacacuuutt

SEQ ID NO: 2772 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauaugugggaagcauutt

SEQ ID NO: 2773 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugauuuucaauuugauutt

SEQ ID NO: 2774 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaauucugcauuugguutt

SEQ ID NO: 2775 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaugaauacaaagauaatt

SEQ ID NO: 2776 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugaaaagagagaaaggaatt

SEQ ID NO: 2777 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagaaaaaggagaaaaactt

SEQ ID NO: 2778 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaagagauuucuaccaatt

SEQ ID NO: 2779 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguuagcacucacugacutt

SEQ ID NO: 2780 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacauaucuaguaaaaccutt

SEQ ID NO: 2781 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucguuuaauacuauaaautt

SEQ ID NO: 2782 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaauacuauaaauaauatt

SEQ ID NO: 2783 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauucuauucauuuugaaatt

SEQ ID NO: 2784 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaaaaacacaaugauutt

SEQ ID NO: 2785 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggaaagugauccaaaautt

SEQ ID NO: 2786 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaaauauuaaaauaautt

SEQ ID NO: 2787 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaaauaauaucuaauaatt

SEQ ID NO: 2788 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaagucacaaaguuaucutt

SEQ ID NO: 2789 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuuuaacaaacuuuacutt

SEQ ID NO: 2790 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuuauucuuagcuguautt

SEQ ID NO: 2791 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauacauuuuuuuaaaagtt

SEQ ID NO: 2792 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuuuuuuaaaaguuugutt

SEQ ID NO: 2793 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuaaaauaugcuugacuatt

SEQ ID NO: 2794 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcuugacuagaguuucatt

SEQ ID NO: 2795 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguugaaaggcaaaaacutt

SEQ ID NO: 2796 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccaucacaacaagaaautt

SEQ ID NO: 2797 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugguaucaagaaaguccatt

SEQ ID NO: 2798 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuaguguacuaguccauatt

SEQ ID NO: 2799 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauagccuagaaaaugauatt

SEQ ID NO: 2800 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccuaucugcagaucaaatt

SEQ ID NO: 2801 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauccagcauucagaucutt

SEQ ID NO: 2802 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuugguuaaaaguaccatt

SEQ ID NO: 2803 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacccaggcuugauuauuutt

SEQ ID NO: 2804 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugcaaauucuauauuutt

SEQ ID NO: 2805 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacauucuuggaaagucutt

SEQ ID NO: 2806 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuggaaagucuauaugatt

SEQ ID NO: 2807 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaacaaaaauaacaucutt

SEQ ID NO: 2808 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucccacugggucaccutt

SEQ ID NO: 2809 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaggaucagaggccaggatt

SEQ ID NO: 2810 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaaaaaaaaaaagacuatt

SEQ ID NO: 2811 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccuggaucucugaauautt

SEQ ID NO: 2812 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaugcaaaaagaaggccatt

SEQ ID NO: 2813 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaguggagccagcaauccutt

SEQ ID NO: 2814 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaacucucaguccaacautt

SEQ ID NO: 2815 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauuugaauugagcaccutt

SEQ ID NO: 2816 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagauguaaaagaaacuautt

SEQ ID NO: 2817 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auacaucauuuuugcccuatt

SEQ ID NO: 2818 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuugcccucugccuguuutt

SEQ ID NO: 2819 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccagacauacagguucutt

SEQ ID NO: 2820 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguggaauaagauacugatt

SEQ ID NO: 2821 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagauacuggacuccucutt

SEQ ID NO: 2822 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucccaagauggcacuuatt

SEQ ID NO: 2823 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guguaccuuuuaaaauuautt

SEQ ID NO: 2824 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucccucucaacaaaacuutt

SEQ ID NO: 2825 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuauaggcagucuucugatt

SEQ ID NO: 2826 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuucugucauaguuagautt

SEQ ID NO: 2827 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augugauaauucuaagagutt

SEQ ID NO: 2828 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccuucacuuaauucuautt

SEQ ID NO: 2829 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaucuuucuuaacuuuutt

SEQ ID NO: 2830 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccaacacauaauccucutt

SEQ ID NO: 2831 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauaaauugaaaauaacutt

SEQ ID NO: 2832 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauuauaccaauucacuatt

SEQ ID NO: 2833 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuauuuuuuaaugaautt

SEQ ID NO: 2834 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaaacuagaaaacaaautt

SEQ ID NO: 2835 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugauuacuauauacuacatt

SEQ ID NO: 2836 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augacucagauuucauagatt

SEQ ID NO: 2837 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaggagcaaccaaaaugutt

SEQ ID NO: 2838 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucacaacccaaaacuuuatt

SEQ ID NO: 2839 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacuuuacaagcuuugcutt

SEQ ID NO: 2840 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucagaauuagauugcuuutt

SEQ ID NO: 2841 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauaauucuugaaugagatt

SEQ ID NO: 2842 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaauucuugaaugaggcaatt

SEQ ID NO: 2843 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuucaagauauuuguaaatt

SEQ ID NO: 2844 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaacaguaaacauuggutt

SEQ ID NO: 2845 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucaacucauaggcuuautt

SEQ ID NO: 2846 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaccauacuggauacuutt

SEQ ID NO: 2847 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaagaugaggcaguucatt

SEQ ID NO: 2848 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucagaauccacucuucutt

SEQ ID NO: 2849 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagggauaugaaaaucucutt

SEQ ID NO: 2850 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacccuaaggauccaautt

SEQ ID NO: 2851 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggaauacugaaaagaaatt

SEQ ID NO: 2852 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaauacugaaaagaaaucatt

SEQ ID NO: 2853 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuccuugaaaauuuuautt

SEQ ID NO: 2854 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaaaaacaaacaaacaatt

SEQ ID NO: 2855 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacaaaaagccuguccaatt

SEQ ID NO: 2856 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuguguagaugaaaccautt

SEQ ID NO: 2857 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugggagaaggcuuagaautt

SEQ ID NO: 2858 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaagauguagcacauuutt

SEQ ID NO: 2859 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauuguuuggccagcuautt

SEQ ID NO: 2860 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augccaauguggugcuauutt

SEQ ID NO: 2861 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauguggugcuauuguuuatt

SEQ ID NO: 2862 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuaagaaaguacuugaatt

SEQ ID NO: 2863 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaaaaaaaaaagaaaaaatt

SEQ ID NO: 2864 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaaaaaaaagaaagcautt

SEQ ID NO: 2865 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auagacauauuuuuuuaaatt

SEQ ID NO: 2866 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaaguauaaaaacaacatt

SEQ ID NO: 2867 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caauucuauagauagaugatt

SEQ ID NO: 2868 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcuuaauaaaauagcauutt

SEQ ID NO: 2869 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaauaaaauagcauuaggutt

SEQ ID NO: 2870 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucuagccaccaccaccutt

SEQ ID NO: 2871 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaucacucacaaguagutt

SEQ ID NO: 2872 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaggaguuggaaauuuutt

SEQ ID NO: 2873 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaaaguuagaaggcucatt

SEQ ID NO: 2874 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauuguuuuguuggcucutt

SEQ ID NO: 2875 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagcaaaauuagcaauautt

SEQ ID NO: 2876 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauuauccaaucuucugatt

SEQ ID NO: 2877 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauccaaucuucugaacutt

SEQ ID NO: 2878 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagcauggagaauaaactt

SEQ ID NO: 2879 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgcgggaaaaaagaucuutt

SEQ ID NO: 2880 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuuauaggcaaauagatt

SEQ ID NO: 2881 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaauuuaaaagauaagutt

SEQ ID NO: 2882 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaaguuccuuauugauuutt

SEQ ID NO: 2883 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuugugcacucugcucuatt

SEQ ID NO: 2884 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacagauauucagcaagutt

SEQ ID NO: 2885 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcaaguggagaaaauatt

SEQ ID NO: 2886 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaacaaagagaaaaaautt

SEQ ID NO: 2887 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auacauagauuuaccugcatt

SEQ ID NO: 2888 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaccugcaaaaaauagcutt

SEQ ID NO: 2889 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuauagaagacauucucatt

SEQ ID NO: 2890 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacaucucaaagagcagutt

SEQ ID NO: 2891 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugagauggggguuaucutt

SEQ ID NO: 2892 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacugauaaagaaagaautt

SEQ ID NO: 2893 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagaauuuaugagaaauutt

SEQ ID NO: 2894 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaacaaucugugaagauuutt

SEQ ID NO: 2895 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuacuuuauacagucuutt

SEQ ID NO: 2896 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaugaauuucuuaaugutt

SEQ ID NO: 2897 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaauguucaaaaugacuutt

SEQ ID NO: 2898 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuucuuuuuuuauaucatt

SEQ ID NO: 2899 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaugaggaauaauaagutt

SEQ ID NO: 2900 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaacccacauagacucutt

SEQ ID NO: 2901 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuaaaacuauaggcuaatt

SEQ ID NO: 2902 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauagaaauguauguuuatt

SEQ ID NO: 2903 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugacuuguugaagcuautt

SEQ ID NO: 2904 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuaaucuuaaaagauutt

SEQ ID NO: 2905 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugcuaauuuauuagaatt

SEQ ID NO: 2906 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauuagagcagaaccugutt

SEQ ID NO: 2907 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuggcucuccucagaaatt

SEQ ID NO: 2908 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caauauuuucaaaagauaatt

SEQ ID NO: 2909 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaaagauaaaucugauutt

SEQ ID NO: 2910 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaugcaauggcaucauuutt

SEQ ID NO: 2911 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaauggcaucauuuauutt

SEQ ID NO: 2912 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaaaacagaagaauugutt

SEQ ID NO: 2913 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaacaaaaggaaaaugutt

SEQ ID NO: 2914 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaauccuguaguacauautt

SEQ ID NO: 2915 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaauauuuuauaagacatt

SEQ ID NO: 2916 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuccuguuagguauuaatt

SEQ ID NO: 2917 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagguauuagaaagugautt

SEQ ID NO: 2918 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auacauagauaucuuuuuutt

SEQ ID NO: 2919 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuguguaauuucuauutt

SEQ ID NO: 2920 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaaaaagagagaagacutt

SEQ ID NO: 2921 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugucagaagcuuuaaguatt

SEQ ID NO: 2922 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugguacaggauaaagautt

SEQ ID NO: 2923 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaauaaccaauuccuautt

SEQ ID NO: 2924 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguuuuuuaaagaaaccutt

SEQ ID NO: 2925 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucucacagauaagacagatt

SEQ ID NO: 2926 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaauuuuauagagggcutt

SEQ ID NO: 2927 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuagaauuaaaggaaccutt

SEQ ID NO: 2928 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucacugaaaacauauauutt

SEQ ID NO: 2929 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacauauauuucacgugutt

SEQ ID NO: 2930 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucccucuuuuuuuuuuutt

SEQ ID NO: 2931 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaagcgauucuccugccutt

SEQ ID NO: 2932 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggcuaauuuuuuggauuutt

SEQ ID NO: 2933 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaauagagacgggguuutt

SEQ ID NO: 2934 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaccauguuggccaggutt

SEQ ID NO: 2935 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcugggauuacaggcautt

SEQ ID NO: 2936 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaacaugauccuucucutt

SEQ ID NO: 2937 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggucuuucaaggggaaatt

SEQ ID NO: 2938 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaauccaagcuuuuuuatt

SEQ ID NO: 2939 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaguaaaaaaaaaaaaagtt

SEQ ID NO: 2940 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagaggacacaaaaccaatt

SEQ ID NO: 2941 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaagauggagacagaguutt

SEQ ID NO: 2942 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucuccuaauaaccggaatt

SEQ ID NO: 2943 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugaauuaccuuucacuutt

SEQ ID NO: 2944 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaaaaacaugaccuucatt

SEQ ID NO: 2945 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caauccuuagaaucugccutt

SEQ ID NO: 2946 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuauauuacugaggccutt

SEQ ID NO: 2947 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaguaaacauuacucautt

SEQ ID NO: 2948 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuauuuugcccaaaaugatt

SEQ ID NO: 2949 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacugauguaaaguaggaatt

SEQ ID NO: 2950 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauaaaaacagagcucutt

SEQ ID NO: 2951 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaaaaucccuuucaagcatt

SEQ ID NO: 2952 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaccccacucaccaacutt

SEQ ID NO: 2953 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaucuuguacccgcugcutt

SEQ ID NO: 2954 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaaaccucaagcugucutt

SEQ ID NO: 2955 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaucaugaaaaugucuautt

SEQ ID NO: 2956 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaaaauaucaaaaccuutt

SEQ ID NO: 2957 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucaaauaucacgcagcutt

SEQ ID NO: 2958 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuauauucaguuuacauatt

SEQ ID NO: 2959 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacauaaaggccccaaautt

SEQ ID NO: 2960 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaccaugucagaucuuuutt

SEQ ID NO: 2961 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaagaguuaaugaacuautt

SEQ ID NO: 2962 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augagaauugggauuacautt

SEQ ID NO: 2963 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucauguauuuugccucautt

SEQ ID NO: 2964 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaucacacuuauaggccatt

SEQ ID NO: 2965 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagugugauaaauaaacutt

SEQ ID NO: 2966 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacagacacugaauuaautt

SEQ ID NO: 2967 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaaaccagaaaauaautt

SEQ ID NO: 2968 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augacuggccauucguuaatt

SEQ ID NO: 2969 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaguugaaaagcauauuutt

SEQ ID NO: 2970 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuauuaaauuaauucutt

SEQ ID NO: 2971 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugauuguauuugaaauuatt

SEQ ID NO: 2972 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaaauuauuauucaautt

SEQ ID NO: 2973 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauggcagaggaauaucatt

SEQ ID NO: 2974 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuaaaaauguaacuaauutt

SEQ ID NO: 2975 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuacuguuuaauaagcautt

SEQ ID NO: 2976 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucauaauaaaaugguautt

SEQ ID NO: 2977 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaucuuucuuuaguaauutt

SEQ ID NO: 2978 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaguaauuacauuaaaautt

SEQ ID NO: 2979 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuagucauguuugauuaatt

SEQ ID NO: 2980 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauccucacauuuaucuatt

SEQ ID NO: 2981 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagagggauuuagagaatt

SEQ ID NO: 2982 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugagauuuagcaaacagtt

SEQ ID NO: 2983 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuagcagugacagugagtt

SEQ ID NO: 2984 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcucuaucugcucugaatt

SEQ ID NO: 2985 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagauguugagagcaaugtt

SEQ ID NO: 2986 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucugaaaaugaauuggutt

SEQ ID NO: 2987 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugcuucugaaguacaaatt

SEQ ID NO: 2988 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacugcugauuuuucccautt

SEQ ID NO: 2989 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagcacuuaaauaauugtt

SEQ ID NO: 2990 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugcaucuucaccuucaatt

SEQ ID NO: 2991 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggcuuguugaaauaaaatt

SEQ ID NO: 2992 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuggagccauacccugugtt

SEQ ID NO: 2993 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcgcccuccgacugcugtt

SEQ ID NO: 2994 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcuugaggggugcgcaatt

SEQ ID NO: 2995 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaguucuuguuuccugcatt

SEQ ID NO: 2996 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggucuuccuacauccugtt

SEQ ID NO: 2997 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagguguuccaaaguuuaatt

SEQ ID NO: 2998 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauguuaucaaacuuauuutt

SEQ ID NO: 2999 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaacgcccaucuuuuaatt

SEQ ID NO: 3000 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauguuuacuuguguauuutt

SEQ ID NO: 3001 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuaaagacaauguuggaatt

SEQ ID NO: 3002 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaggugcaaaucacucctt

SEQ ID NO: 3003 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaaaagaucaacagcaautt

SEQ ID NO: 3004 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuauagaacauuauugatt

SEQ ID NO: 3005 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauauuuuuuuuuucuuutt

SEQ ID NO: 3006 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaagauauauauauauautt

SEQ ID NO: 3007 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagugcaaauaaggaaatt

SEQ ID NO: 3008 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccgaguuguguagaaagtt

SEQ ID NO: 3009 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacuguaaaacaaacagctt

SEQ ID NO: 3010 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauuaucagacacuguaatt

SEQ ID NO: 3011 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacuaacaagauuaucagtt

SEQ ID NO: 3012 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggaggugguggguauatt

SEQ ID NO: 3013 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaggccaaauucggcaatt

SEQ ID NO: 3014 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaggaggccaaauucggctt

SEQ ID NO: 3015 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgacuugcugcugcuuuutt

SEQ ID NO: 3016 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuggugugcuucuugactt

SEQ ID NO: 3017 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauaaaaugcauccaacutt

SEQ ID NO: 3018 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauaaagcuuugugucuaatt

SEQ ID NO: 3019 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuguaagcaugaugugtt

SEQ ID NO: 3020 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuauuugcauuauucuutt

SEQ ID NO: 3021 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuggccucaaaguugcatt

SEQ ID NO: 3022 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacauaugccuaaaaaugtt

SEQ ID NO: 3023 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaacuuucuauguuuaatt

SEQ ID NO: 3024 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaacucuuuugaguugaagtt

SEQ ID NO: 3025 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaacucaucauuugaaggatt

SEQ ID NO: 3026 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaagaggaaaguuacuaatt

SEQ ID NO: 3027 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugcucuauauggaaaaatt

SEQ ID NO: 3028 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaugcuaaauuuacauagtt

SEQ ID NO: 3029 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauauccuguauaauugautt

SEQ ID NO: 3030 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auagcaccauuauacuaaatt

SEQ ID NO: 3031 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacucuuucauauaacaatt

SEQ ID NO: 3032 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuuucacguauuaccgutt

SEQ ID NO: 3033 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcuuccccuauuguuuutt

SEQ ID NO: 3034 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggaugguguuuucaguatt

SEQ ID NO: 3035 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuugccuucuuucccaatt

SEQ ID NO: 3036 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguggacuuuugugucugatt

SEQ ID NO: 3037 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuuccucucuggacucgtt

SEQ ID NO: 3038 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuccauuccacaguuutt

SEQ ID NO: 3039 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauuccuagccuucugcutt

SEQ ID NO: 3040 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaaaccaggacugcuaatt

SEQ ID NO: 3041 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauauugcccccauuuugtt

SEQ ID NO: 3042 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaucuuuaucuuuuuaaatt

SEQ ID NO: 3043 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggguaaaaaaaaucugatt

SEQ ID NO: 3044 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaacccaggguaaaaaatt

SEQ ID NO: 3045 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauguugcacccuuacagtt

SEQ ID NO: 3046 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaauuccuugcaucucagtt

SEQ ID NO: 3047 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagcauucaauucaccaatt

SEQ ID NO: 3048 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auagcuucacugacaagaatt

SEQ ID NO: 3049 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuaguuggccaguuauutt

SEQ ID NO: 3050 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcuguuagcuuuuaacatt

SEQ ID NO: 3051 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaguguuuuaagagauugtt

SEQ ID NO: 3052 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugcuucccacauauuuutt

SEQ ID NO: 3053 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucaaauugaaaaucaaatt

SEQ ID NO: 3054 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccaaaugcagaauucaatt

SEQ ID NO: 3055 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaucuuuguauucauaaatt

SEQ ID NO: 3056 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccuuucucucuuuucactt

SEQ ID NO: 3057 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuuucuccuuuuucuuutt

SEQ ID NO: 3058 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugguagaaaucucuuugutt

SEQ ID NO: 3059 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucagugagugcuaacaatt

SEQ ID NO: 3060 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguuuuacuagauauguatt

SEQ ID NO: 3061 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuauaguauuaaacgagtt

SEQ ID NO: 3062 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuauuuauaguauuaaatt

SEQ ID NO: 3063 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucaaaaugaauagaauatt

SEQ ID NO: 3064 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucauuguguuuuucaaatt

SEQ ID NO: 3065 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuggaucacuuuccuutt

SEQ ID NO: 3066 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuauuuuaauauuucaaatt

SEQ ID NO: 3067 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauuagauauuauuuuaatt

SEQ ID NO: 3068 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauaacuuugugacuuuutt

SEQ ID NO: 3069 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguaaaguuuguuaaagaatt

SEQ ID NO: 3070 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auacagcuaagaauaagagtt

SEQ ID NO: 3071 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuuaaaaaaauguauautt

SEQ ID NO: 3072 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaacuuuuaaaaaaaugtt

SEQ ID NO: 3073 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagucaagcauauuuuaactt

SEQ ID NO: 3074 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaacucuagucaagcautt

SEQ ID NO: 3075 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuuuugccuuucaacugtt

SEQ ID NO: 3076 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuucuuguugugauggaatt

SEQ ID NO: 3077 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacuuucuugauaccaatt

SEQ ID NO: 3078 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauggacuaguacacuaactt

SEQ ID NO: 3079 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucauuuucuaggcuaugtt

SEQ ID NO: 3080 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaucugcagauagggatt

SEQ ID NO: 3081 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaucugaaugcuggauaatt

SEQ ID NO: 3082 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguacuuuuaaccaaaaatt

SEQ ID NO: 3083 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauaaucaagccuggguatt

SEQ ID NO: 3084 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauauagaauuugcaugatt

SEQ ID NO: 3085 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacuuuccaagaauguaatt

SEQ ID NO: 3086 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauauagacuuuccaagatt

SEQ ID NO: 3087 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauguuauuuuuguuuuutt

SEQ ID NO: 3088 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggugacccagugggagaatt

SEQ ID NO: 3089 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuggccucugauccuugtt

SEQ ID NO: 3090 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagucuuuuuuuuuuuuuutt

SEQ ID NO: 3091 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauucagagauccagggatt

SEQ ID NO: 3092 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggccuucuuuuugcauautt

SEQ ID NO: 3093 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggauugcuggcuccacuatt

SEQ ID NO: 3094 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuggacugagaguuaatt

SEQ ID NO: 3095 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggugcucaauucaaauaatt

SEQ ID NO: 3096 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaguuucuuuuacaucugtt

SEQ ID NO: 3097 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagggcaaaaaugauguautt

SEQ ID NO: 3098 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacaggcagagggcaaaatt

SEQ ID NO: 3099 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaccuguaugucuggaatt

SEQ ID NO: 3100 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaguaucuuauuccacagtt

SEQ ID NO: 3101 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaggaguccaguaucuuatt

SEQ ID NO: 3102 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagugccaucuugggaagtt

SEQ ID NO: 3103 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaauuuuaaaagguacactt

SEQ ID NO: 3104 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguuuuguugagagggaatt

SEQ ID NO: 3105 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagaagacugccuauaaatt

SEQ ID NO: 3106 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuaacuaugacagaaaatt

SEQ ID NO: 3107 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucuuagaauuaucacautt

SEQ ID NO: 3108 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auagaauuaagugaaggaatt

SEQ ID NO: 3109 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaguuaagaaagauaautt

SEQ ID NO: 3110 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaggauuauguguuggaatt

SEQ ID NO: 3111 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuauuuucaauuuauuutt

SEQ ID NO: 3112 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagugaauugguauaaugatt

SEQ ID NO: 3113 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucauuaaaaaauaaaautt

SEQ ID NO: 3114 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuguuuucuaguuuuaatt

SEQ ID NO: 3115 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaguauauaguaaucaatt

SEQ ID NO: 3116 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuaugaaaucugagucautt

SEQ ID NO: 3117 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauuuugguugcuccuuutt

SEQ ID NO: 3118 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaguuuuggguugugactt

SEQ ID NO: 3119 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaaagcuuguaaaguuutt

SEQ ID NO: 3120 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcaaucuaauucugaatt

SEQ ID NO: 3121 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucauucaagaauuauaatt

SEQ ID NO: 3122 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugccucauucaagaauuatt

SEQ ID NO: 3123 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuacaaauaucuugaaautt

SEQ ID NO: 3124 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaauguuuacuguucuutt

SEQ ID NO: 3125 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaagccuaugaguugaaatt

SEQ ID NO: 3126 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguauccaguauggucaatt

SEQ ID NO: 3127 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaacugccucaucuuaaatt

SEQ ID NO: 3128 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagaguggauucugaugtt

SEQ ID NO: 3129 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagauuuucauaucccuatt

SEQ ID NO: 3130 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuggauccuuagggugaatt

SEQ ID NO: 3131 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucuuuucaguauuccautt

SEQ ID NO: 3132 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauuucuuuucaguauuctt

SEQ ID NO: 3133 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaaaauuuucaaggaagutt

SEQ ID NO: 3134 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguuuguuuguuuuuuaatt

SEQ ID NO: 3135 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggacaggcuuuuuguuutt

SEQ ID NO: 3136 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augguuucaucuacacaaatt

SEQ ID NO: 3137 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucuaagccuucucccaatt

SEQ ID NO: 3138 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaugugcuacaucuuuuatt

SEQ ID NO: 3139 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auagcuggccaaacaauaatt

SEQ ID NO: 3140 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauagcaccacauuggcautt

SEQ ID NO: 3141 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaacaauagcaccacauutt

SEQ ID NO: 3142 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaaguacuuucuuaaagtt

SEQ ID NO: 3143 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuucuuuuuuuuuuagtt

SEQ ID NO: 3144 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcuuucuuuuuuuucuutt

SEQ ID NO: 3145 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaaaaaaauaugucuautt

SEQ ID NO: 3146 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuguuuuuauacuuuaatt

SEQ ID NO: 3147 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucuaucuauagaauugtt

SEQ ID NO: 3148 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugcuauuuuauuaagcctt

SEQ ID NO: 3149 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accuaaugcuauuuuauuatt

SEQ ID NO: 3150 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguggugguggcuagauatt

SEQ ID NO: 3151 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuacuugugagugauaaatt

SEQ ID NO: 3152 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauuuccaacuccugcctt

SEQ ID NO: 3153 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagccuucuaacuuuaaatt

SEQ ID NO: 3154 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagccaacaaaacaauggtt

SEQ ID NO: 3155 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauugcuaauuuugcuaatt

SEQ ID NO: 3156 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagaagauuggauaauautt

SEQ ID NO: 3157 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguucagaagauuggauaatt

SEQ ID NO: 3158 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuauucuccaugcucuutt

SEQ ID NO: 3159 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaucuuuuuucccgcgutt

SEQ ID NO: 3160 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuauuugccuauaagauctt

SEQ ID NO: 3161 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuaucuuuuaaauucuutt

SEQ ID NO: 3162 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaucaauaaggaacuuactt

SEQ ID NO: 3163 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagagcagagugcacaaaatt

SEQ ID NO: 3164 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuugcugaauaucuguuutt

SEQ ID NO: 3165 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuuucuccacuugcugatt

SEQ ID NO: 3166 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuuucucuuuguucuutt

SEQ ID NO: 3167 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcagguaaaucuauguautt

SEQ ID NO: 3168 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuauuuuuugcagguaatt

SEQ ID NO: 3169 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaaugucuucuauaaatt

SEQ ID NO: 3170 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugcucuuugagaugucutt

SEQ ID NO: 3171 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauaacccccaucucauatt

SEQ ID NO: 3172 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucuuucuuuaucaguagtt

SEQ ID NO: 3173 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuucucauaaauucuuutt

SEQ ID NO: 3174 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaucuucacagauuguuatt

SEQ ID NO: 3175 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagacuguauaaaguaaaatt

SEQ ID NO: 3176 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauuaagaaauucauaaatt

SEQ ID NO: 3177 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucauuuugaacauuaatt

SEQ ID NO: 3178 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauauaaaaaaagaagaatt

SEQ ID NO: 3179 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuauuauuccucauucutt

SEQ ID NO: 3180 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagucuauguggguuuaatt

SEQ ID NO: 3181 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagccuauaguuuuaaagtt

SEQ ID NO: 3182 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaacauacauuucuaucutt

SEQ ID NO: 3183 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auagcuucaacaagucaaatt

SEQ ID NO: 3184 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucuuuuaagauuaaaaatt

SEQ ID NO: 3185 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuaauaaauuagcacaatt

SEQ ID NO: 3186 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagguucugcucuaauaatt

SEQ ID NO: 3187 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucugaggagagccaaactt

SEQ ID NO: 3188 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaucuuuugaaaauauugtt

SEQ ID NO: 3189 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucagauuuaucuuuugatt

SEQ ID NO: 3190 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaugaugccauugcauaatt

SEQ ID NO: 3191 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauaaaugaugccauugcatt

SEQ ID NO: 3192 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaauucuucuguuuuaaatt

SEQ ID NO: 3193 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauuuuccuuuuguuguutt

SEQ ID NO: 3194 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauguacuacaggauuaatt

SEQ ID NO: 3195 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucuuauaaaauauuaaatt

SEQ ID NO: 3196 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaauaccuaacaggaaggtt

SEQ ID NO: 3197 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucacuuucuaauaccuaatt

SEQ ID NO: 3198 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaaagauaucuauguautt

SEQ ID NO: 3199 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauagaaauuacacaaaaatt

SEQ ID NO: 3200 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucuucucucuuuuuuaatt

SEQ ID NO: 3201 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacuuaaagcuucugacagtt

SEQ ID NO: 3202 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuuuauccuguaccauatt

SEQ ID NO: 3203 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaggaauugguuauuuaatt

SEQ ID NO: 3204 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguuucuuuaaaaaacaatt

SEQ ID NO: 3205 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugucuuaucugugagagtt

SEQ ID NO: 3206 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcccucuauaaaauucugtt

SEQ ID NO: 3207 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguuccuuuaauucuagatt

SEQ ID NO: 3208 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauauauguuuucagugagtt

SEQ ID NO: 3209 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacgugaaauauauguuutt

SEQ ID NO: 3210 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaaaaaaaagagggaactt

SEQ ID NO: 3211 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcaggagaaucgcuuaatt

SEQ ID NO: 3212 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauccaaaaaauuagccgtt

SEQ ID NO: 3213 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaccccgucucuauuaaatt

SEQ ID NO: 3214 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accuggccaacaugguaaatt

SEQ ID NO: 3215 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augccuguaaucccagcaatt

SEQ ID NO: 3216 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagaaggaucauguuuaatt

SEQ ID NO: 3217 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuccccuugaaagacccctt

SEQ ID NO: 3218 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaaaagcuuggauuuuutt

SEQ ID NO: 3219 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuuuuuuuuuuuacuuutt

SEQ ID NO: 3220 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugguuuuguguccucucutt

SEQ ID NO: 3221 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacucugucuccaucuuaatt

SEQ ID NO: 3222 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccgguuauuaggagaaatt

SEQ ID NO: 3223 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagugaaagguaauucagctt

SEQ ID NO: 3224 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaggucauguuuuugaatt

SEQ ID NO: 3225 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcagauucuaaggauugtt

SEQ ID NO: 3226 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccucaguaauauaaaatt

SEQ ID NO: 3227 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaguaauguuuacuuuutt

SEQ ID NO: 3228 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauuuugggcaaaauaaatt

SEQ ID NO: 3229 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccuacuuuacaucagugtt

SEQ ID NO: 3230 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagcucuguuuuuauuuutt

SEQ ID NO: 3231 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuugaaagggauuuuagtt

SEQ ID NO: 3232 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuggugaguggggucaatt

SEQ ID NO: 3233 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagcggguacaagauaatt

SEQ ID NO: 3234 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacagcuugagguuucagtt

SEQ ID NO: 3235 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auagacauuuucaugauactt

SEQ ID NO: 3236 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagguuuugauauuuugaatt

SEQ ID NO: 3237 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugcgugauauuugaaatt

SEQ ID NO: 3238 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauguaaacugaauauaagtt

SEQ ID NO: 3239 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuggggccuuuauguaatt

SEQ ID NO: 3240 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaagaucugacaugguautt

SEQ ID NO: 3241 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaguucauuaacucuuuutt

SEQ ID NO: 3242 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguaaucccaauucucautt

SEQ ID NO: 3243 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaggcaaaauacaugautt

SEQ ID NO: 3244 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggccuauaagugugauaatt

SEQ ID NO: 3245 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuuauuuaucacacuugtt

SEQ ID NO: 3246 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaauucagugucuguaatt

SEQ ID NO: 3247 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuauuuucugguuucaaatt

SEQ ID NO: 3248 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaacgaauggccagucautt

SEQ ID NO: 3249 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauaugcuuuucaacuaatt

SEQ ID NO: 3250 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaauuaauuuaauaaaaatt

SEQ ID NO: 3251 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaauuucaaauacaaucagtt

SEQ ID NO: 3252 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugaauaauaauuucaaatt

SEQ ID NO: 3253 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauauuccucugccauaatt

SEQ ID NO: 3254 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuaguuacauuuuuagatt

SEQ ID NO: 3255 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcuuauuaaacaguaaatt

SEQ ID NO: 3256 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaccauuuuauuaugacatt

SEQ ID NO: 3257 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuacuaaagaaagauautt

SEQ ID NO: 3258 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuaauguaauuacuaatt

SEQ ID NO: 3259 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaucaaacaugacuaautt

SEQ ID NO: 3260 - RNA, 19 nt, Artificial Sequence
  source: /note="Description of Artificial Sequence: Synthetic oligonucleotide"
uagauaaaugugaggauuu

SEQ ID NO: 3261 - RNA, 19 nt, Artificial Sequence
  source: /note="Description of Artificial Sequence: Synthetic oligonucleotide"
uucucuaaaucccucuucu

SEQ ID NO: 3262 - RNA, 19 nt, Artificial Sequence
  source: /note="Description of Artificial Sequence: Synthetic oligonucleotide"
cuguuugcuaaaucucacu

SEQ ID NO: 3263 - RNA, 19 nt, Artificial Sequence
  source: /note="Description of Artificial Sequence: Synthetic oligonucleotide"
cucacugucacugcuaaau

SEQ ID NO: 3264 - RNA, 19 nt, Artificial Sequence
  source: /note="Description of Artificial Sequence: Synthetic oligonucleotide"
uucagagcagauagagccu

SEQ ID NO: 3265 - RNA, 19 nt, Artificial Sequence
  source: /note="Description of Artificial Sequence: Synthetic oligonucleotide"
cauugcucucaacaucucc

SEQ ID NO: 3266 - RNA, 19 nt, Artificial Sequence
  source: /note="Description of Artificial Sequence: Synthetic oligonucleotide"
accaauucauuuucagacu

SEQ ID NO: 3267 - RNA, 19 nt, Artificial Sequence
  source: /note="Description of Artificial Sequence: Synthetic oligonucleotide"
uuuguacuucagaagcaau

SEQ ID NO: 3268 - RNA, 19 nt, Artificial Sequence
  source: /note="Description of Artificial Sequence: Synthetic oligonucleotide"
augggaaaaaucagcaguc

SEQ ID NO: 3269 - RNA, 19 nt, Artificial Sequence
  source: /note="Description of Artificial Sequence: Synthetic oligonucleotide"
caauuauuuaagugcugcu

SEQ ID NO: 3270 - RNA, 19 nt, Artificial Sequence
  source: /note="Description of Artificial Sequence: Synthetic oligonucleotide"
uugaaggugaagaugcaca

SEQ ID NO: 3271 - RNA, 19 nt, Artificial Sequence
  source: /note="Description of Artificial Sequence: Synthetic oligonucleotide"
uuuuauuucaacaagccca

SEQ ID NO: 3272 - RNA, 19 nt, Artificial Sequence
  source: /note="Description of Artificial Sequence: Synthetic oligonucleotide"
cacaggguauggcuccagc

SEQ ID NO: 3273 - RNA, 19 nt, Artificial Sequence
  source: /note="Description of Artificial Sequence: Synthetic oligonucleotide"
cagcagucggagggcgccu

SEQ ID NO: 3274 - RNA, 19 nt, Artificial Sequence
  source: /note="Description of Artificial Sequence: Synthetic oligonucleotide"
uugcgcaccccucaagccu

SEQ ID NO: 3275 - RNA, 19 nt, Artificial Sequence
  source: /note="Description of Artificial Sequence: Synthetic oligonucleotide"
ugcaggaaacaagaacuac

SEQ ID NO: 3276 - RNA, 19 nt, Artificial Sequence
  source: /note="Description of Artificial Sequence: Synthetic oligonucleotide"
caggauguaggaagacccu

SEQ ID NO: 3277 - RNA, 19 nt, Artificial Sequence
  source: /note="Description of Artificial Sequence: Synthetic oligonucleotide"
uuaaacuuuggaacaccua

SEQ ID NO: 3278 - RNA, 19 nt, Artificial Sequence
  source: /note="Description of Artificial Sequence: Synthetic oligonucleotide"
aaauaaguuugauaacauu

SEQ ID NO: 3279 - RNA, 19 nt, Artificial Sequence
  source: /note="Description of Artificial Sequence: Synthetic oligonucleotide"
uuaaaagaugggcguuucc

SEQ ID NO: 3280 - RNA, 19 nt, Artificial Sequence
  source: /note="Description of Artificial Sequence: Synthetic oligonucleotide"
aaauacacaaguaaacauu

SEQ ID NO: 3281 - RNA, 19 nt, Artificial Sequence
  source: /note="Description of Artificial Sequence: Synthetic oligonucleotide"
uuccaacauugucuuuagg

SEQ ID NO: 3282 - RNA, 19 nt, Artificial Sequence
  source: /note="Description of Artificial Sequence: Synthetic oligonucleotide"
ggagugauuugcaccuugc

SEQ ID NO: 3283 - RNA, 19 nt, Artificial Sequence
  source: /note="Description of Artificial Sequence: Synthetic oligonucleotide"
auugcuguugaucuuuuau

SEQ ID NO: 3284 - RNA, 19 nt, Artificial Sequence
  source: /note="Description of Artificial Sequence: Synthetic oligonucleotide"
ucaauaauguucuauagaa

SEQ ID NO: 3285 - RNA, 19 nt, Artificial Sequence
  source: /note="Description of Artificial Sequence: Synthetic oligonucleotide"
aaagaaaaaaaaaauauau

SEQ ID NO: 3286 - RNA, 19 nt, Artificial Sequence
  source: /note="Description of Artificial Sequence: Synthetic oligonucleotide"
auauauauauauaucuuag

SEQ ID NO: 3287 - RNA, 19 nt, Artificial Sequence
  source: /note="Description of Artificial Sequence: Synthetic oligonucleotide"
uuuccuuauuugcacuucu

SEQ ID NO: 3288 - RNA, 19 nt, Artificial Sequence
  source: /note="Description of Artificial Sequence: Synthetic oligonucleotide"
cuuucuacacaacucgggc

SEQ ID NO: 3289 - RNA, 19 nt, Artificial Sequence
  source: /note="Description of Artificial Sequence: Synthetic oligonucleotide"
gcuguuuguuuuacagugu

SEQ ID NO: 3290 - RNA, 19 nt, Artificial Sequence
  source: /note="Description of Artificial Sequence: Synthetic oligonucleotide"
uuacagugucugauaaucu

SEQ ID NO: 3291 - RNA, 19 nt, Artificial Sequence
  source: /note="Description of Artificial Sequence: Synthetic oligonucleotide"
cugauaaucuuguuagucu

SEQ ID NO: 3292 - RNA, 19 nt, Artificial Sequence
  source: /note="Description of Artificial Sequence: Synthetic oligonucleotide"
uauacccaccaccucccuu

SEQ ID NO: 3293 - RNA, 19 nt, Artificial Sequence
  source: /note="Description of Artificial Sequence: Synthetic oligonucleotide"
uugccgaauuuggccuccu

SEQ ID NO: 3294 - RNA, 19 nt, Artificial Sequence
  source: /note="Description of Artificial Sequence: Synthetic oligonucleotide"
gccgaauuuggccuccuca

SEQ ID NO: 3295 - RNA, 19 nt, Artificial Sequence
  source: /note="Description of Artificial Sequence: Synthetic oligonucleotide"
aaaagcagcagcaagucgu

SEQ ID NO: 3296 - RNA, 19 nt, Artificial Sequence
  source: /note="Description of Artificial Sequence: Synthetic oligonucleotide"
gucaagaagcacaccaauu

SEQ ID NO: 3297 - RNA, 19 nt, Artificial Sequence
  source: /note="Description of Artificial Sequence: Synthetic oligonucleotide"
aguuggaugcauuuuauuu

SEQ ID NO: 3298 - RNA, 19 nt, Artificial Sequence
  source: /note="Description of Artificial Sequence: Synthetic oligonucleotide"
uuagacacaaagcuuuauu

SEQ ID NO: 3299 - RNA, 19 nt, Artificial Sequence
  source: /note="Description of Artificial Sequence: Synthetic oligonucleotide"
cacaucaugcuuacaaaaa

SEQ ID NO: 3300 - RNA, 19 nt, Artificial Sequence
  source: /note="Description of Artificial Sequence: Synthetic oligonucleotide"
aagaauaaugcaaauaguu

SEQ ID NO: 3301 - RNA, 19 nt, Artificial Sequence
  source: /note="Description of Artificial Sequence: Synthetic oligonucleotide"
ugcaacuuugaggccaauc

SEQ ID NO: 3302 - RNA, 19 nt, Artificial Sequence
  source: /note="Description of Artificial Sequence: Synthetic oligonucleotide"
cauuuuuaggcauauguuu

SEQ ID NO: 3303 - RNA, 19 nt, Artificial Sequence
  source: /note="Description of Artificial Sequence: Synthetic oligonucleotide"
uuaaacauagaaaguuucu

SEQ ID NO: 3304 - RNA, 19 nt, Artificial Sequence
  source: /note="Description of Artificial Sequence: Synthetic oligonucleotide"
cuucaacucaaaagaguuc

SEQ ID NO: 3305 - RNA, 19 nt, Artificial Sequence
  source: /note="Description of Artificial Sequence: Synthetic oligonucleotide"
uccuucaaaugaugaguua

SEQ ID NO: 3306 - RNA, 19 nt, Artificial Sequence
  source: /note="Description of Artificial Sequence: Synthetic oligonucleotide"
uuaguaacuuuccucuuuu

SEQ ID NO: 3307 - RNA, 19 nt, Artificial Sequence
  source: /note="Description of Artificial Sequence: Synthetic oligonucleotide"
uuuuuccauauagagcacu

SEQ ID NO: 3308 - RNA, 19 nt, Artificial Sequence
  source: /note="Description of Artificial Sequence: Synthetic oligonucleotide"
cuauguaaauuuagcauau

SEQ ID NO: 3309 - RNA, 19 nt, Artificial Sequence
  source: /note="Description of Artificial Sequence: Synthetic oligonucleotide"
aucaauuauacaggauaua

SEQ ID NO: 3310 - RNA, 19 nt, Artificial Sequence
  source: /note="Description of Artificial Sequence: Synthetic oligonucleotide"
uuuaguauaauggugcuau

SEQ ID NO: 3311 - RNA, 19 nt, Artificial Sequence
  source: /note="Description of Artificial Sequence: Synthetic oligonucleotide"
uuguuauaugaaagagucu

SEQ ID NO: 3312 - RNA, 19 nt, Artificial Sequence
  source: /note="Description of Artificial Sequence: Synthetic oligonucleotide"
acgguaauacgugaaagca

SEQ ID NO: 3313 - RNA, 19 nt, Artificial Sequence
  source: /note="Description of Artificial Sequence: Synthetic oligonucleotide"
aaaacaauaggggaagccu

SEQ ID NO: 3314 - RNA, 19 nt, Artificial Sequence
  source: /note="Description of Artificial Sequence: Synthetic oligonucleotide"
uacugaaaacaccauccau

SEQ ID NO: 3315 - RNA, 19 nt, Artificial Sequence
  source: /note="Description of Artificial Sequence: Synthetic oligonucleotide"
uugggaaagaaggcaaagu

SEQ ID NO: 3316 - RNA, 19 nt, Artificial Sequence
  source: /note="Description of Artificial Sequence: Synthetic oligonucleotide"
ucagacacaaaaguccacu

SEQ ID NO: 3317 - RNA, 19 nt, Artificial Sequence
  source: /note="Description of Artificial Sequence: Synthetic oligonucleotide"
cgaguccagagaggaaacu

SEQ ID NO: 3318 - RNA, 19 nt, Artificial Sequence
  source: /note="Description of Artificial Sequence: Synthetic oligonucleotide"
aaacuguggaauggaaaaa

SEQ ID NO: 3319 - RNA, 19 nt, Artificial Sequence
  source: /note="Description of Artificial Sequence: Synthetic oligonucleotide"
agcagaaggcuaggaauuu

SEQ ID NO: 3320 - RNA, 19 nt, Artificial Sequence
  source: /note="Description of Artificial Sequence: Synthetic oligonucleotide"
uuagcaguccugguuucuu

SEQ ID NO: 3321 - RNA, 19 nt, Artificial Sequence
  source: /note="Description of Artificial Sequence: Synthetic oligonucleotide"
caaaaugggggcaauaugu

SEQ ID NO: 3322 - RNA, 19 nt, Artificial Sequence
  source: /note="Description of Artificial Sequence: Synthetic oligonucleotide"
uuuaaaaagauaaagauuc

SEQ ID NO: 3323 - RNA, 19 nt, Artificial Sequence
  source: /note="Description of Artificial Sequence: Synthetic oligonucleotide"
ucagauuuuuuuuacccug

SEQ ID NO: 3324 - RNA, 19 nt, Artificial Sequence
  source: /note="Description of Artificial Sequence: Synthetic oligonucleotide"
uuuuuuacccuggguugcu

SEQ ID NO: 3325 - RNA, 19 nt, Artificial Sequence
  source: /note="Description of Artificial Sequence: Synthetic oligonucleotide"
cuguaagggugcaacauca

SEQ ID NO: 3326 - RNA, 19 nt, Artificial Sequence
  source: /note="Description of Artificial Sequence: Synthetic oligonucleotide"
cugagaugcaaggaauucu

SEQ ID NO: 3327 - RNA, 19 nt, Artificial Sequence
  source: /note="Description of Artificial Sequence: Synthetic oligonucleotide"
uuggugaauugaaugcucc

SEQ ID NO: 3328 - RNA, 19 nt, Artificial Sequence
  source: /note="Description of Artificial Sequence: Synthetic oligonucleotide"
uucuugucagugaagcuau

SEQ ID NO: 3329 - RNA, 19 nt, Artificial Sequence
  source: /note="Description of Artificial Sequence: Synthetic oligonucleotide"
aauaacuggccaacuaguu

SEQ ID NO: 3330 - RNA, 19 nt, Artificial Sequence
  source: /note="Description of Artificial Sequence: Synthetic oligonucleotide"
uguuaaaagcuaacagcuc

SEQ ID NO: 3331 - RNA, 19 nt, Artificial Sequence
  source: /note="Description of Artificial Sequence: Synthetic oligonucleotide"
caaucucuuaaaacacuuu

SEQ ID NO: 3332 - RNA, 19 nt, Artificial Sequence
  source: /note="Description of Artificial Sequence: Synthetic oligonucleotide"
aaaauaugugggaagcauu

SEQ ID NO: 3333 - RNA, 19 nt, Artificial Sequence
  source: /note="Description of Artificial Sequence: Synthetic oligonucleotide"
uuugauuuucaauuugauu

SEQ ID NO: 3334 - RNA, 19 nt, Artificial Sequence
  source: /note="Description of Artificial Sequence: Synthetic oligonucleotide"
uugaauucugcauuugguu

SEQ ID NO: 3335 - RNA, 19 nt, Artificial Sequence
  source: /note="Description of Artificial Sequence: Synthetic oligonucleotide"
uuuaugaauacaaagauaa

SEQ ID NO: 3336 - RNA, 19 nt, Artificial Sequence
  source: /note="Description of Artificial Sequence: Synthetic oligonucleotide"
gugaaaagagagaaaggaa

SEQ ID NO: 3337 - RNA, 19 nt, Artificial Sequence
  source: /note="Description of Artificial Sequence: Synthetic oligonucleotide"
aaagaaaaaggagaaaaac

SEQ ID NO: 3338 - RNA, 19 nt, Artificial Sequence
  source: /note="Description of Artificial Sequence: Synthetic oligonucleotide"
acaaagagauuucuaccag

SEQ ID NO: 3339 - RNA, 19 nt, Artificial Sequence
  source: /note="Description of Artificial Sequence: Synthetic oligonucleotide"
uuguuagcacucacugacu

SEQ ID NO: 3340 - RNA, 19 nt, Artificial Sequence
  source: /note="Description of Artificial Sequence: Synthetic oligonucleotide"
uacauaucuaguaaaaccu

SEQ ID NO: 3341 - RNA, 19 nt, Artificial Sequence
  source: /note="Description of Artificial Sequence: Synthetic oligonucleotide"
cucguuuaauacuauaaau

SEQ ID NO: 3342 - RNA, 19 nt, Artificial Sequence
  source: /note="Description of Artificial Sequence: Synthetic oligonucleotide"
uuuaauacuauaaauaaua

SEQ ID NO: 3343 - RNA, 19 nt, Artificial Sequence
  source: /note="Description of Artificial Sequence: Synthetic oligonucleotide"
uauucuauucauuuugaaa

SEQ ID NO: 3344 - RNA, 19 nt, Artificial Sequence
  source: /note="Description of Artificial Sequence: Synthetic oligonucleotide"
uuugaaaaacacaaugauu

SEQ ID NO: 3345 - RNA, 19 nt, Artificial Sequence
  source: /note="Description of Artificial Sequence: Synthetic oligonucleotide"
aaggaaagugauccaaaau

SEQ ID NO: 3346 - RNA, 19 nt, Artificial Sequence
  source: /note="Description of Artificial Sequence: Synthetic oligonucleotide"
uuugaaauauuaaaauaau

SEQ ID NO: 3347 - RNA, 19 nt, Artificial Sequence
  source: /note="Description of Artificial Sequence: Synthetic oligonucleotide"
uuaaaauaauaucuaauaa

SEQ ID NO: 3348 - RNA, 19 nt, Artificial Sequence
  source: /note="Description of Artificial Sequence: Synthetic oligonucleotide"
aaaagucacaaaguuaucu

SEQ ID NO: 3349 - RNA, 19 nt, Artificial Sequence
  source: /note="Description of Artificial Sequence: Synthetic oligonucleotide"
uucuuuaacaaacuuuacu

SEQ ID NO: 3350 - RNA, 19 nt, Artificial Sequence
  source: /note="Description of Artificial Sequence: Synthetic oligonucleotide"
cucuuauucuuagcuguau

SEQ ID NO: 3351 - RNA, 19 nt, Artificial Sequence
  source: /note="Description of Artificial Sequence: Synthetic oligonucleotide"
auauacauuuuuuuaaaag

SEQ ID NO: 3352 - RNA, 19 nt, Artificial Sequence
  source: /note="Description of Artificial Sequence: Synthetic oligonucleotide"
cauuuuuuuaaaaguuugu

SEQ ID NO: 3353 - RNA, 19 nt, Artificial Sequence
  source: /note="Description of Artificial Sequence: Synthetic oligonucleotide"
guuaaaauaugcuugacua

SEQ ID NO: 3354 - RNA, 19 nt, Artificial Sequence
  source: /note="Description of Artificial Sequence: Synthetic oligonucleotide"
augcuugacuagaguuucc

SEQ ID NO: 3355 - RNA, 19 nt, Artificial Sequence
  source: /note="Description of Artificial Sequence: Synthetic oligonucleotide"
caguugaaaggcaaaaacu

SEQ ID NO: 3356 - RNA, 19 nt, Artificial Sequence
  source: /note="Description of Artificial Sequence: Synthetic oligonucleotide"
uuccaucacaacaagaaau

SEQ ID NO: 3357 - RNA, 19 nt, Artificial Sequence
  source: /note="Description of Artificial Sequence: Synthetic oligonucleotide"
uugguaucaagaaagucca

SEQ ID NO: 3358 - RNA, 19 nt, Artificial Sequence
  source: /note="Description of Artificial Sequence: Synthetic oligonucleotide"
guuaguguacuaguccauc

SEQ ID NO: 3359 - RNA, 19 nt, Artificial Sequence
  source: /note="Description of Artificial Sequence: Synthetic oligonucleotide"
cauagccuagaaaaugauc

SEQ ID NO: 3360 - RNA, 19 nt, Artificial Sequence
  source: /note="Description of Artificial Sequence: Synthetic oligonucleotide"
ucccuaucugcagaucaag

SEQ ID NO: 3361 - RNA, 19 nt, Artificial Sequence
  source: /note="Description of Artificial Sequence: Synthetic oligonucleotide"
uuauccagcauucagaucu

SEQ ID NO: 3362 - RNA, 19 nt, Artificial Sequence
  source: /note="Description of Artificial Sequence: Synthetic oligonucleotide"
uuuuugguuaaaaguaccc

SEQ ID NO: 3363 - RNA, 19 nt, Artificial Sequence
  source: /note="Description of Artificial Sequence: Synthetic oligonucleotide"
uacccaggcuugauuauuu

SEQ ID NO: 3364 - RNA, 19 nt, Artificial Sequence
  source: /note="Description of Artificial Sequence: Synthetic oligonucleotide"
ucaugcaaauucuauauuu

SEQ ID NO: 3365 - RNA, 19 nt, Artificial Sequence
  source: /note="Description of Artificial Sequence: Synthetic oligonucleotide"
uuacauucuuggaaagucu

SEQ ID NO: 3366 - RNA, 19 nt, Artificial Sequence
  source: /note="Description of Artificial Sequence: Synthetic oligonucleotide"
ucuuggaaagucuauauga

SEQ ID NO: 3367 - RNA, 19 nt, Artificial Sequence
  source: /note="Description of Artificial Sequence: Synthetic oligonucleotide"
aaaaacaaaaauaacaucu

SEQ ID NO: 3368 - RNA, 19 nt, Artificial Sequence
  source: /note="Description of Artificial Sequence: Synthetic oligonucleotide"
uucucccacugggucaccu

SEQ ID NO: 3369 - RNA, 19 nt, Artificial Sequence
  source: /note="Description of Artificial Sequence: Synthetic oligonucleotide"
caaggaucagaggccagga

SEQ ID NO: 3370 - RNA, 19 nt, Artificial Sequence
  source: /note="Description of Artificial Sequence: Synthetic oligonucleotide"
aaaaaaaaaaaaaagacuc

SEQ ID NO: 3371 - RNA, 19 nt, Artificial Sequence
  source: /note="Description of Artificial Sequence: Synthetic oligonucleotide"
ucccuggaucucugaauau

SEQ ID NO: 3372 - RNA, 19 nt, Artificial Sequence
  source: /note="Description of Artificial Sequence: Synthetic oligonucleotide"
auaugcaaaaagaaggccc

SEQ ID NO: 3373 - RNA, 19 nt, Artificial Sequence
  source: /note="Description of Artificial Sequence: Synthetic oligonucleotide"
uaguggagccagcaauccu

SEQ ID NO: 3374 - RNA, 19 nt, Artificial Sequence
  source: /note="Description of Artificial Sequence: Synthetic oligonucleotide"
uuaacucucaguccaacau

SEQ ID NO: 3375 - RNA, 19 nt, Artificial Sequence
  source: /note="Description of Artificial Sequence: Synthetic oligonucleotide"
uuauuugaauugagcaccu

SEQ ID NO: 3376 - RNA, 19 nt, Artificial Sequence
  source: /note="Description of Artificial Sequence: Synthetic oligonucleotide"
cagauguaaaagaaacuau

SEQ ID NO: 3377 - RNA, 19 nt, Artificial Sequence
  source: /note="Description of Artificial Sequence: Synthetic oligonucleotide"
auacaucauuuuugcccuc

SEQ ID NO: 3378 - RNA, 19 nt, Artificial Sequence
  source: /note="Description of Artificial Sequence: Synthetic oligonucleotide"
uuuugcccucugccuguuu

SEQ ID NO: 3379 - RNA, 19 nt, Artificial Sequence
  source: /note="Description of Artificial Sequence: Synthetic oligonucleotide"
uuccagacauacagguucu

SEQ ID NO: 3380 - RNA, 19 nt, Artificial Sequence
  source: /note="Description of Artificial Sequence: Synthetic oligonucleotide"
cuguggaauaagauacugg

SEQ ID NO: 3381 - RNA, 19 nt, Artificial Sequence
  source: /note="Description of Artificial Sequence: Synthetic oligonucleotide"
uaagauacuggacuccucu

SEQ ID NO: 3382 - RNA, 19 nt, Artificial Sequence
  source: /note="Description of Artificial Sequence: Synthetic oligonucleotide"
cuucccaagauggcacuuc

SEQ ID NO: 3383 - RNA, 19 nt, Artificial Sequence
  source: /note="Description of Artificial Sequence: Synthetic oligonucleotide"
guguaccuuuuaaaauuau

SEQ ID NO: 3384 - RNA, 19 nt, Artificial Sequence
  source: /note="Description of Artificial Sequence: Synthetic oligonucleotide"
uucccucucaacaaaacuu

SEQ ID NO: 3385 - RNA, 19 nt, Artificial Sequence
  source: /note="Description of Artificial Sequence: Synthetic oligonucleotide"
uuuauaggcagucuucugc

SEQ ID NO: 3386 - RNA, 19 nt, Artificial Sequence
  source: /note="Description of Artificial Sequence: Synthetic oligonucleotide"
uuuucugucauaguuagau

SEQ ID NO: 3387 - RNA, 19 nt, Artificial Sequence
  source: /note="Description of Artificial Sequence: Synthetic oligonucleotide"
augugauaauucuaagagu

SEQ ID NO: 3388 - RNA, 19 nt, Artificial Sequence
  source: /note="Description of Artificial Sequence: Synthetic oligonucleotide"
uuccuucacuuaauucuau

SEQ ID NO: 3389 - RNA, 19 nt, Artificial Sequence
  source: /note="Description of Artificial Sequence: Synthetic oligonucleotide"
auuaucuuucuuaacuuuu

SEQ ID NO: 3390 - RNA, 19 nt, Artificial Sequence
  source: /note="Description of Artificial Sequence: Synthetic oligonucleotide"
uuccaacacauaauccucu

SEQ ID NO: 3391 - RNA, 19 nt, Artificial Sequence
  source: /note="Description of Artificial Sequence: Synthetic oligonucleotide"
aaauaaauugaaaauaacu

SEQ ID NO: 3392 - RNA, 19 nt, Artificial Sequence
  source: /note="Description of Artificial Sequence: Synthetic oligonucleotide"
ucauuauaccaauucacua

SEQ ID NO: 3393 - RNA, 19 nt, Artificial Sequence
  source: /note="Description of Artificial Sequence: Synthetic oligonucleotide"
auuuuauuuuuuaaugaau

SEQ ID NO: 3394 - RNA, 19 nt, Artificial Sequence
  source: /note="Description of Artificial Sequence: Synthetic oligonucleotide"
uuaaaacuagaaaacaaau

SEQ ID NO: 3395 - RNA, 19 nt, Artificial Sequence
  source: /note="Description of Artificial Sequence: Synthetic oligonucleotide"
uugauuacuauauacuaca

SEQ ID NO: 3396 - RNA, 19 nt, Artificial Sequence
  source: /note="Description of Artificial Sequence: Synthetic oligonucleotide"
augacucagauuucauaga

SEQ ID NO: 3397 - RNA, 19 nt, Artificial Sequence
  source: /note="Description of Artificial Sequence: Synthetic oligonucleotide"
aaaggagcaaccaaaaugu

SEQ ID NO: 3398 - RNA, 19 nt, Artificial Sequence
  source: /note="Description of Artificial Sequence: Synthetic oligonucleotide"
gucacaacccaaaacuuua

SEQ ID NO: 3399 - RNA, 19 nt, Artificial Sequence
  source: /note="Description of Artificial Sequence: Synthetic oligonucleotide"
aaacuuuacaagcuuugcu

SEQ ID NO: 3400 - RNA, 19 nt, Artificial Sequence
  source: /note="Description of Artificial Sequence: Synthetic oligonucleotide"
uucagaauuagauugcuuu

SEQ ID NO: 3401 - RNA, 19 nt, Artificial Sequence
  source: /note="Description of Artificial Sequence: Synthetic oligonucleotide"
uuauaauucuugaaugagg

SEQ ID NO: 3402 - RNA, 19 nt, Artificial Sequence
  source: /note="Description of Artificial Sequence: Synthetic oligonucleotide"
uaauucuugaaugaggcaa

SEQ ID NO: 3403 - RNA, 19 nt, Artificial Sequence
  source: /note="Description of Artificial Sequence: Synthetic oligonucleotide"
auuucaagauauuuguaaa

SEQ ID NO: 3404 - RNA, 19 nt, Artificial Sequence
  source: /note="Description of Artificial Sequence: Synthetic oligonucleotide"
aagaacaguaaacauuggu

SEQ ID NO: 3405 - RNA, 19 nt, Artificial Sequence
  source: /note="Description of Artificial Sequence: Synthetic oligonucleotide"
uuucaacucauaggcuuau

SEQ ID NO: 3406 - RNA, 19 nt, Artificial Sequence
  source: /note="Description of Artificial Sequence: Synthetic oligonucleotide"
uugaccauacuggauacuu

SEQ ID NO: 3407 - RNA, 19 nt, Artificial Sequence
  source: /note="Description of Artificial Sequence: Synthetic oligonucleotide"
uuuaagaugaggcaguucc

SEQ ID NO: 3408 - RNA, 19 nt, Artificial Sequence
  source: /note="Description of Artificial Sequence: Synthetic oligonucleotide"
caucagaauccacucuucu

SEQ ID NO: 3409 - RNA, 19 nt, Artificial Sequence
  source: /note="Description of Artificial Sequence: Synthetic oligonucleotide"
uagggauaugaaaaucucu

SEQ ID NO: 3410 - RNA, 19 nt, Artificial Sequence
  source: /note="Description of Artificial Sequence: Synthetic oligonucleotide"
uucacccuaaggauccaau

SEQ ID NO: 3411 - RNA, 19 nt, Artificial Sequence
  source: /note="Description of Artificial Sequence: Synthetic oligonucleotide"
auggaauacugaaaagaaa

SEQ ID NO: 3412 - RNA, 19 nt, Artificial Sequence
  source: /note="Description of Artificial Sequence: Synthetic oligonucleotide"
gaauacugaaaagaaauca

SEQ ID NO: 3413 - RNA, 19 nt, Artificial Sequence
  source: /note="Description of Artificial Sequence: Synthetic oligonucleotide"
acuuccuugaaaauuuuau

SEQ ID NO: 3414 - RNA, 19 nt, Artificial Sequence
  source: /note="Description of Artificial Sequence: Synthetic oligonucleotide"
uuaaaaaacaaacaaacaa

SEQ ID NO: 3415 - RNA, 19 nt, Artificial Sequence
  source: /note="Description of Artificial Sequence: Synthetic oligonucleotide"
aaacaaaaagccuguccac

SEQ ID NO: 3416 - RNA, 19 nt, Artificial Sequence
  source: /note="Description of Artificial Sequence: Synthetic oligonucleotide"
uuuguguagaugaaaccau

SEQ ID NO: 3417 - RNA, 19 nt, Artificial Sequence
  source: /note="Description of Artificial Sequence: Synthetic oligonucleotide"
uugggagaaggcuuagaau

SEQ ID NO: 3418 - RNA, 19 nt, Artificial Sequence
  source: /note="Description of Artificial Sequence: Synthetic oligonucleotide"
uaaaagauguagcacauuu

SEQ ID NO: 3419 - RNA, 19 nt, Artificial Sequence
  source: /note="Description of Artificial Sequence: Synthetic oligonucleotide"
uuauuguuuggccagcuau

SEQ ID NO: 3420 - RNA, 19 nt, Artificial Sequence
  source: /note="Description of Artificial Sequence: Synthetic oligonucleotide"
augccaauguggugcuauu

SEQ ID NO: 3421 - RNA, 19 nt, Artificial Sequence
  source: /note="Description of Artificial Sequence: Synthetic oligonucleotide"
aauguggugcuauuguuuc

SEQ ID NO: 3422 - RNA, 19 nt, Artificial Sequence
  source: /note="Description of Artificial Sequence: Synthetic oligonucleotide"
cuuuaagaaaguacuugac

SEQ ID NO: 3423 - RNA, 19 nt, Artificial Sequence
  source: /note="Description of Artificial Sequence: Synthetic oligonucleotide"
cuaaaaaaaaaagaaaaaa

SEQ ID NO: 3424 - RNA, 19 nt, Artificial Sequence
  source: /note="Description of Artificial Sequence: Synthetic oligonucleotide"
aagaaaaaaaagaaagcau

SEQ ID NO: 3425 - RNA, 19 nt, Artificial Sequence
  source: /note="Description of Artificial Sequence: Synthetic oligonucleotide"
auagacauauuuuuuuaaa

SEQ ID NO: 3426 - RNA, 19 nt, Artificial Sequence
  source: /note="Description of Artificial Sequence: Synthetic oligonucleotide"
uuaaaguauaaaaacaaca

SEQ ID NO: 3427 - RNA, 19 nt, Artificial Sequence
  source: /note="Description of Artificial Sequence: Synthetic oligonucleotide"
caauucuauagauagaugg

SEQ ID NO: 3428 - RNA, 19 nt, Artificial Sequence
  source: /note="Description of Artificial Sequence: Synthetic oligonucleotide"
ggcuuaauaaaauagcauu

SEQ ID NO: 3429 - RNA, 19 nt, Artificial Sequence
  source: /note="Description of Artificial Sequence: Synthetic oligonucleotide"
uaauaaaauagcauuaggu

SEQ ID NO: 3430 - RNA, 19 nt, Artificial Sequence
  source: /note="Description of Artificial Sequence: Synthetic oligonucleotide"
uaucuagccaccaccaccu

SEQ ID NO: 3431 - RNA, 19 nt, Artificial Sequence
  source: /note="Description of Artificial Sequence: Synthetic oligonucleotide"
uuuaucacucacaaguagu

SEQ ID NO: 3432 - RNA, 19 nt, Artificial Sequence
  source: /note="Description of Artificial Sequence: Synthetic oligonucleotide"
ggcaggaguuggaaauuuu

SEQ ID NO: 3433 - RNA, 19 nt, Artificial Sequence
  source: /note="Description of Artificial Sequence: Synthetic oligonucleotide"
uuuaaaguuagaaggcucc

SEQ ID NO: 3434 - RNA, 19 nt, Artificial Sequence
  source: /note="Description of Artificial Sequence: Synthetic oligonucleotide"
ccauuguuuuguuggcucu

SEQ ID NO: 3435 - RNA, 19 nt, Artificial Sequence
  source: /note="Description of Artificial Sequence: Synthetic oligonucleotide"
uuagcaaaauuagcaauau

SEQ ID NO: 3436 - RNA, 19 nt, Artificial Sequence
  source: /note="Description of Artificial Sequence: Synthetic oligonucleotide"
auauuauccaaucuucuga

SEQ ID NO: 3437 - RNA, 19 nt, Artificial Sequence
  source: /note="Description of Artificial Sequence: Synthetic oligonucleotide"
uuauccaaucuucugaacu

SEQ ID NO: 3438 - RNA, 19 nt, Artificial Sequence
  source: /note="Description of Artificial Sequence: Synthetic oligonucleotide"
aagagcauggagaauaaac

SEQ ID NO: 3439 - RNA, 19 nt, Artificial Sequence
  source: /note="Description of Artificial Sequence: Synthetic oligonucleotide"
acgcgggaaaaaagaucuu

SEQ ID NO: 3440 - RNA, 19 nt, Artificial Sequence
  source: /note="Description of Artificial Sequence: Synthetic oligonucleotide"
gaucuuauaggcaaauaga

SEQ ID NO: 3441 - RNA, 19 nt, Artificial Sequence
  source: /note="Description of Artificial Sequence: Synthetic oligonucleotide"
aagaauuuaaaagauaagu

SEQ ID NO: 3442 - RNA, 19 nt, Artificial Sequence
  source: /note="Description of Artificial Sequence: Synthetic oligonucleotide"
guaaguuccuuauugauuu

SEQ ID NO: 3443 - RNA, 19 nt, Artificial Sequence
  source: /note="Description of Artificial Sequence: Synthetic oligonucleotide"
uuuugugcacucugcucua

SEQ ID NO: 3444 - RNA, 19 nt, Artificial Sequence
  source: /note="Description of Artificial Sequence: Synthetic oligonucleotide"
aaacagauauucagcaagu

SEQ ID NO: 3445 - RNA, 19 nt, Artificial Sequence
  source: /note="Description of Artificial Sequence: Synthetic oligonucleotide"
ucagcaaguggagaaaaua

SEQ ID NO: 3446 - RNA, 19 nt, Artificial Sequence
  source: /note="Description of Artificial Sequence: Synthetic oligonucleotide"
aagaacaaagagaaaaaau

SEQ ID NO: 3447 - RNA, 19 nt, Artificial Sequence
  source: /note="Description of Artificial Sequence: Synthetic oligonucleotide"
auacauagauuuaccugca

SEQ ID NO: 3448 - RNA, 19 nt, Artificial Sequence
  source: /note="Description of Artificial Sequence: Synthetic oligonucleotide"
uuaccugcaaaaaauagcu

SEQ ID NO: 3449 - RNA, 19 nt, Artificial Sequence
  source: /note="Description of Artificial Sequence: Synthetic oligonucleotide"
uuuauagaagacauucucc

SEQ ID NO: 3450 - RNA, 19 nt, Artificial Sequence
  source: /note="Description of Artificial Sequence: Synthetic oligonucleotide"
agacaucucaaagagcagu

SEQ ID NO: 3451 - RNA, 19 nt, Artificial Sequence
  source: /note="Description of Artificial Sequence: Synthetic oligonucleotide"
uaugagauggggguuaucu

SEQ ID NO: 3452 - RNA, 19 nt, Artificial Sequence
  source: /note="Description of Artificial Sequence: Synthetic oligonucleotide"
cuacugauaaagaaagaau

SEQ ID NO: 3453 - RNA, 19 nt, Artificial Sequence
  source: /note="Description of Artificial Sequence: Synthetic oligonucleotide"
aaagaauuuaugagaaauu

SEQ ID NO: 3454 - RNA, 19 nt, Artificial Sequence
  source: /note="Description of Artificial Sequence: Synthetic oligonucleotide"
uaacaaucugugaagauuu

SEQ ID NO: 3455 - RNA, 19 nt, Artificial Sequence
  source: /note="Description of Artificial Sequence: Synthetic oligonucleotide"
uuuuacuuuauacagucuu

SEQ ID NO: 3456 - RNA, 19 nt, Artificial Sequence
  source: /note="Description of Artificial Sequence: Synthetic oligonucleotide"
uuuaugaauuucuuaaugu

SEQ ID NO: 3457 - RNA, 19 nt, Artificial Sequence
  source: /note="Description of Artificial Sequence: Synthetic oligonucleotide"
uuaauguucaaaaugacuu

SEQ ID NO: 3458 - RNA, 19 nt, Artificial Sequence
  source: /note="Description of Artificial Sequence: Synthetic oligonucleotide"
uucuucuuuuuuuauauca

SEQ ID NO: 3459 - RNA, 19 nt, Artificial Sequence
  source: /note="Description of Artificial Sequence: Synthetic oligonucleotide"
agaaugaggaauaauaagu

SEQ ID NO: 3460 - RNA, 19 nt, Artificial Sequence
  source: /note="Description of Artificial Sequence: Synthetic oligonucleotide"
uuaaacccacauagacucu

SEQ ID NO: 3461 - RNA, 19 nt, Artificial Sequence
  source: /note="Description of Artificial Sequence: Synthetic oligonucleotide"
cuuuaaaacuauaggcuag

SEQ ID NO: 3462 - RNA, 19 nt, Artificial Sequence
  source: /note="Description of Artificial Sequence: Synthetic oligonucleotide"
agauagaaauguauguuug

SEQ ID NO: 3463 - RNA, 19 nt, Artificial Sequence
  source: /note="Description of Artificial Sequence: Synthetic oligonucleotide"
uuugacuuguugaagcuau

SEQ ID NO: 3464 - RNA, 19 nt, Artificial Sequence
  source: /note="Description of Artificial Sequence: Synthetic oligonucleotide"
uuuuuaaucuuaaaagauu

SEQ ID NO: 3465 - RNA, 19 nt, Artificial Sequence
  source: /note="Description of Artificial Sequence: Synthetic oligonucleotide"
uugugcuaauuuauuagag

SEQ ID NO: 3466 - RNA, 19 nt, Artificial Sequence
  source: /note="Description of Artificial Sequence: Synthetic oligonucleotide"
uuauuagagcagaaccugu

SEQ ID NO: 3467 - RNA, 19 nt, Artificial Sequence
  source: /note="Description of Artificial Sequence: Synthetic oligonucleotide"
guuuggcucuccucagaag

SEQ ID NO: 3468 - RNA, 19 nt, Artificial Sequence
  source: /note="Description of Artificial Sequence: Synthetic oligonucleotide"
caauauuuucaaaagauaa

SEQ ID NO: 3469 - RNA, 19 nt, Artificial Sequence
  source: /note="Description of Artificial Sequence: Synthetic oligonucleotide"
ucaaaagauaaaucugauu

SEQ ID NO: 3470 - RNA, 19 nt, Artificial Sequence
  source: /note="Description of Artificial Sequence: Synthetic oligonucleotide"
uuaugcaauggcaucauuu

SEQ ID NO: 3471 - RNA, 19 nt, Artificial Sequence
  source: /note="Description of Artificial Sequence: Synthetic oligonucleotide"
ugcaauggcaucauuuauu

SEQ ID NO: 3472 - RNA, 19 nt, Artificial Sequence
  source: /note="Description of Artificial Sequence: Synthetic oligonucleotide"
uuuaaaacagaagaauugu

SEQ ID NO: 3473 - RNA, 19 nt, Artificial Sequence
  source: /note="Description of Artificial Sequence: Synthetic oligonucleotide"
aacaacaaaaggaaaaugu

SEQ ID NO: 3474 - RNA, 19 nt, Artificial Sequence
  source: /note="Description of Artificial Sequence: Synthetic oligonucleotide"
uuaauccuguaguacauau

SEQ ID NO: 3475 - RNA, 19 nt, Artificial Sequence
  source: /note="Description of Artificial Sequence: Synthetic oligonucleotide"
uuuaauauuuuauaagacc

SEQ ID NO: 3476 - RNA, 19 nt, Artificial Sequence
  source: /note="Description of Artificial Sequence: Synthetic oligonucleotide"
ccuuccuguuagguauuag

SEQ ID NO: 3477 - RNA, 19 nt, Artificial Sequence
  source: /note="Description of Artificial Sequence: Synthetic oligonucleotide"
uuagguauuagaaagugau

SEQ ID NO: 3478 - RNA, 19 nt, Artificial Sequence
  source: /note="Description of Artificial Sequence: Synthetic oligonucleotide"
auacauagauaucuuuuuu

SEQ ID NO: 3479 - RNA, 19 nt, Artificial Sequence
  source: /note="Description of Artificial Sequence: Synthetic oligonucleotide"
uuuuuguguaauuucuauu

SEQ ID NO: 3480 - RNA, 19 nt, Artificial Sequence
  source: /note="Description of Artificial Sequence: Synthetic oligonucleotide"
uuaaaaaagagagaagacu

SEQ ID NO: 3481 - RNA, 19 nt, Artificial Sequence
  source: /note="Description of Artificial Sequence: Synthetic oligonucleotide"
cugucagaagcuuuaagug

SEQ ID NO: 3482 - RNA, 19 nt, Artificial Sequence
  source: /note="Description of Artificial Sequence: Synthetic oligonucleotide"
uaugguacaggauaaagau

SEQ ID NO: 3483 - RNA, 19 nt, Artificial Sequence
  source: /note="Description of Artificial Sequence: Synthetic oligonucleotide"
uuaaauaaccaauuccuau

SEQ ID NO: 3484 - RNA, 19 nt, Artificial Sequence
  source: /note="Description of Artificial Sequence: Synthetic oligonucleotide"
uuguuuuuuaaagaaaccu

SEQ ID NO: 3485 - RNA, 19 nt, Artificial Sequence
  source: /note="Description of Artificial Sequence: Synthetic oligonucleotide"
cucucacagauaagacaga

SEQ ID NO: 3486 - RNA, 19 nt, Artificial Sequence
  source: /note="Description of Artificial Sequence: Synthetic oligonucleotide"
cagaauuuuauagagggcu

SEQ ID NO: 3487 - RNA, 19 nt, Artificial Sequence
  source: /note="Description of Artificial Sequence: Synthetic oligonucleotide"
ucuagaauuaaaggaaccu

SEQ ID NO: 3488 - RNA, 19 nt, Artificial Sequence
  source: /note="Description of Artificial Sequence: Synthetic oligonucleotide"
cucacugaaaacauauauu

SEQ ID NO: 3489 - RNA, 19 nt, Artificial Sequence
  source: /note="Description of Artificial Sequence: Synthetic oligonucleotide"
aaacauauauuucacgugu

SEQ ID NO: 3490 - RNA, 19 nt, Artificial Sequence
  source: /note="Description of Artificial Sequence: Synthetic oligonucleotide"
guucccucuuuuuuuuuuu

SEQ ID NO: 3491 - RNA, 19 nt, Artificial Sequence
  source: /note="Description of Artificial Sequence: Synthetic oligonucleotide"
uuaagcgauucuccugccu

SEQ ID NO: 3492 - RNA, 19 nt, Artificial Sequence
  source: /note="Description of Artificial Sequence: Synthetic oligonucleotide"
cggcuaauuuuuuggauuu

SEQ ID NO: 3493 - RNA, 19 nt, Artificial Sequence
  source: /note="Description of Artificial Sequence: Synthetic oligonucleotide"
uuuaauagagacgggguuu

SEQ ID NO: 3494 - RNA, 19 nt, Artificial Sequence
  source: /note="Description of Artificial Sequence: Synthetic oligonucleotide"
uuuaccauguuggccaggu

SEQ ID NO: 3495 - RNA, 19 nt, Artificial Sequence
  source: /note="Description of Artificial Sequence: Synthetic oligonucleotide"
uugcugggauuacaggcau

SEQ ID NO: 3496 - RNA, 19 nt, Artificial Sequence
  source: /note="Description of Artificial Sequence: Synthetic oligonucleotide"
uuaaacaugauccuucucu

SEQ ID NO: 3497 - RNA, 19 nt, Artificial Sequence
  source: /note="Description of Artificial Sequence: Synthetic oligonucleotide"
ggggucuuucaaggggaaa

SEQ ID NO: 3498 - RNA, 19 nt, Artificial Sequence
  source: /note="Description of Artificial Sequence: Synthetic oligonucleotide"
aaaaauccaagcuuuuuua

SEQ ID NO: 3499 - RNA, 19 nt, Artificial Sequence
  source: /note="Description of Artificial Sequence: Synthetic oligonucleotide"
aaaguaaaaaaaaaaaaag

SEQ ID NO: 3500 - RNA, 19 nt, Artificial Sequence
  source: /note="Description of Artificial Sequence: Synthetic oligonucleotide"
agagaggacacaaaaccaa

SEQ ID NO: 3501 - RNA, 19 nt, Artificial Sequence
  source: /note="Description of Artificial Sequence: Synthetic oligonucleotide"
uuaagauggagacagaguu

SEQ ID NO: 3502 - RNA, 19 nt, Artificial Sequence
  source: /note="Description of Artificial Sequence: Synthetic oligonucleotide"
uuucuccuaauaaccggag

SEQ ID NO: 3503 - RNA, 19 nt, Artificial Sequence
  source: /note="Description of Artificial Sequence: Synthetic oligonucleotide"
gcugaauuaccuuucacuu

SEQ ID NO: 3504 - RNA, 19 nt, Artificial Sequence
  source: /note="Description of Artificial Sequence: Synthetic oligonucleotide"
uucaaaaacaugaccuucc

SEQ ID NO: 3505 - RNA, 19 nt, Artificial Sequence
  source: /note="Description of Artificial Sequence: Synthetic oligonucleotide"
caauccuuagaaucugccu

SEQ ID NO: 3506 - RNA, 19 nt, Artificial Sequence
  source: /note="Description of Artificial Sequence: Synthetic oligonucleotide"
uuuuauauuacugaggccu

SEQ ID NO: 3507 - RNA, 19 nt, Artificial Sequence
  source: /note="Description of Artificial Sequence: Synthetic oligonucleotide"
aaaaguaaacauuacucau

SEQ ID NO: 3508 - RNA, 19 nt, Artificial Sequence
  source: /note="Description of Artificial Sequence: Synthetic oligonucleotide"
uuuauuuugcccaaaaugc

SEQ ID NO: 3509 - RNA, 19 nt, Artificial Sequence
  source: /note="Description of Artificial Sequence: Synthetic oligonucleotide"
cacugauguaaaguaggaa

SEQ ID NO: 3510 - RNA, 19 nt, Artificial Sequence
  source: /note="Description of Artificial Sequence: Synthetic oligonucleotide"
aaaauaaaaacagagcucu

SEQ ID NO: 3511 - RNA, 19 nt, Artificial Sequence
  source: /note="Description of Artificial Sequence: Synthetic oligonucleotide"
cuaaaaucccuuucaagcc

SEQ ID NO: 3512 - RNA, 19 nt, Artificial Sequence
  source: /note="Description of Artificial Sequence: Synthetic oligonucleotide"
uugaccccacucaccaacu

SEQ ID NO: 3513 - RNA, 19 nt, Artificial Sequence
  source: /note="Description of Artificial Sequence: Synthetic oligonucleotide"
uuaucuuguacccgcugcu

SEQ ID NO: 3514 - RNA, 19 nt, Artificial Sequence
  source: /note="Description of Artificial Sequence: Synthetic oligonucleotide"
cugaaaccucaagcugucu

SEQ ID NO: 3515 - RNA, 19 nt, Artificial Sequence
  source: /note="Description of Artificial Sequence: Synthetic oligonucleotide"
guaucaugaaaaugucuau

SEQ ID NO: 3516 - RNA, 19 nt, Artificial Sequence
  source: /note="Description of Artificial Sequence: Synthetic oligonucleotide"
uucaaaauaucaaaaccuu

SEQ ID NO: 3517 - RNA, 19 nt, Artificial Sequence
  source: /note="Description of Artificial Sequence: Synthetic oligonucleotide"
uuucaaauaucacgcagcu

SEQ ID NO: 3518 - RNA, 19 nt, Artificial Sequence
  source: /note="Description of Artificial Sequence: Synthetic oligonucleotide"
cuuauauucaguuuacaua

SEQ ID NO: 3519 - RNA, 19 nt, Artificial Sequence
  source: /note="Description of Artificial Sequence: Synthetic oligonucleotide"
uuacauaaaggccccaaau

SEQ ID NO: 3520 - RNA, 19 nt, Artificial Sequence
  source: /note="Description of Artificial Sequence: Synthetic oligonucleotide"
auaccaugucagaucuuuu

SEQ ID NO: 3521 - RNA, 19 nt, Artificial Sequence
  source: /note="Description of Artificial Sequence: Synthetic oligonucleotide"
aaaagaguuaaugaacuau

SEQ ID NO: 3522 - RNA, 19 nt, Artificial Sequence
  source: /note="Description of Artificial Sequence: Synthetic oligonucleotide"
augagaauugggauuacau

SEQ ID NO: 3523 - RNA, 19 nt, Artificial Sequence
  source: /note="Description of Artificial Sequence: Synthetic oligonucleotide"
aucauguauuuugccucau

SEQ ID NO: 3524 - RNA, 19 nt, Artificial Sequence
  source: /note="Description of Artificial Sequence: Synthetic oligonucleotide"
uuaucacacuuauaggcca

SEQ ID NO: 3525 - RNA, 19 nt, Artificial Sequence
  source: /note="Description of Artificial Sequence: Synthetic oligonucleotide"
caagugugauaaauaaacu

SEQ ID NO: 3526 - RNA, 19 nt, Artificial Sequence
  source: /note="Description of Artificial Sequence: Synthetic oligonucleotide"
uuacagacacugaauuaau

SEQ ID NO: 3527 - RNA, 19 nt, Artificial Sequence
  source: /note="Description of Artificial Sequence: Synthetic oligonucleotide"
uuugaaaccagaaaauaau

SEQ ID NO: 3528 - RNA, 19 nt, Artificial Sequence
  source: /note="Description of Artificial Sequence: Synthetic oligonucleotide"
augacuggccauucguuac

SEQ ID NO: 3529 - RNA, 19 nt, Artificial Sequence
  source: /note="Description of Artificial Sequence: Synthetic oligonucleotide"
uuaguugaaaagcauauuu

SEQ ID NO: 3530 - RNA, 19 nt, Artificial Sequence
  source: /note="Description of Artificial Sequence: Synthetic oligonucleotide"
uuuuuauuaaauuaauucu

SEQ ID NO: 3531 - RNA, 19 nt, Artificial Sequence
  source: /note="Description of Artificial Sequence: Synthetic oligonucleotide"
cugauuguauuugaaauua

SEQ ID NO: 3532 - RNA, 19 nt, Artificial Sequence
  source: /note="Description of Artificial Sequence: Synthetic oligonucleotide"
uuugaaauuauuauucaau

SEQ ID NO: 3533 - RNA, 19 nt, Artificial Sequence
  source: /note="Description of Artificial Sequence: Synthetic oligonucleotide"
uuauggcagaggaauauca

SEQ ID NO: 3534 - RNA, 19 nt, Artificial Sequence
  source: /note="Description of Artificial Sequence: Synthetic oligonucleotide"
ucuaaaaauguaacuaauu

SEQ ID NO: 3535 - RNA, 19 nt, Artificial Sequence
  source: /note="Description of Artificial Sequence: Synthetic oligonucleotide"
uuuacuguuuaauaagcau

SEQ ID NO: 3536 - RNA, 19 nt, Artificial Sequence
  source: /note="Description of Artificial Sequence: Synthetic oligonucleotide"
ugucauaauaaaaugguau

SEQ ID NO: 3537 - RNA, 19 nt, Artificial Sequence
  source: /note="Description of Artificial Sequence: Synthetic oligonucleotide"
auaucuuucuuuaguaauu

SEQ ID NO: 3538 - RNA, 19 nt, Artificial Sequence
  source: /note="Description of Artificial Sequence: Synthetic oligonucleotide"
uuaguaauuacauuaaaau

SEQ ID NO: 3539 - RNA, 19 nt, Artificial Sequence
  source: /note="Description of Artificial Sequence: Synthetic oligonucleotide"
auuagucauguuugauuaa

We claim:

1. A double stranded ribonucleic acid (dsRNA) agent for inhibiting expression of an insulin-like growth factor binding protein, acid labile subunit (IGFALS) gene, wherein the dsRNA agent comprises a sense strand and an antisense strand forming a double stranded region, wherein said antisense strand comprises at least 17 contiguous nucleotides of the nucleotide sequence of 5'-AGUGAGUUGUUC-CUGAGGCUGAG-3' (SEQ ID NO: 135), and wherein the dsRNA agent comprises at least one modified nucleotide.

2. The dsRNA agent of claim 1, wherein the nucleotide sequence of the antisense strand is 5'-AGUGAGUUGUUC-CUGAGGCUGAG-3' (SEQ ID NO: 135).

3. The dsRNA agent of claim 2, wherein the nucleotide sequence of the antisense strand is 5'-AGUGAGUUGUUC-CUGAGGCUGAG-3' (SEQ ID NO: 135) and the nucleotide sequence of the sense strand is 5'-CAGCCUCAG-GAACAACUCACU-3' (SEQ ID NO: 78).

4. The dsRNA agent of claim 1, wherein substantially all of the nucleotides of said sense strand or substantially all of the nucleotides of said antisense strand comprise a nucleotide modification.

5. The dsRNA agent of claim 1, wherein all of the nucleotides of said sense strand and all of the nucleotides of said antisense strand comprise a nucleotide modification.

6. The dsRNA agent of claim 4, wherein at least one of the nucleotides comprising a nucleotide modification comprises a nucleotide modification selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an a basic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

7. The dsRNA agent of claim 1, wherein the antisense strand is 19-21 nucleotides in length.

8. The dsRNA agent of claim 1, wherein each strand is no more than 30 nucleotides in length.

9. The dsRNA agent of claim 1, wherein at least one strand comprises a 3' overhang of at least 1 nucleotide; or at least 2 nucleotides.

10. The dsRNA agent of claim 1, further comprising a ligand.

11. The dsRNA agent of claim 10, wherein the ligand is conjugated to the 3' end of the sense strand of the dsRNA agent.

12. The dsRNA agent of claim 10, wherein the ligand is an N-acetylgalactosamine (GalNAc) derivative.

13. The dsRNA agent of claim 12, wherein the ligand is

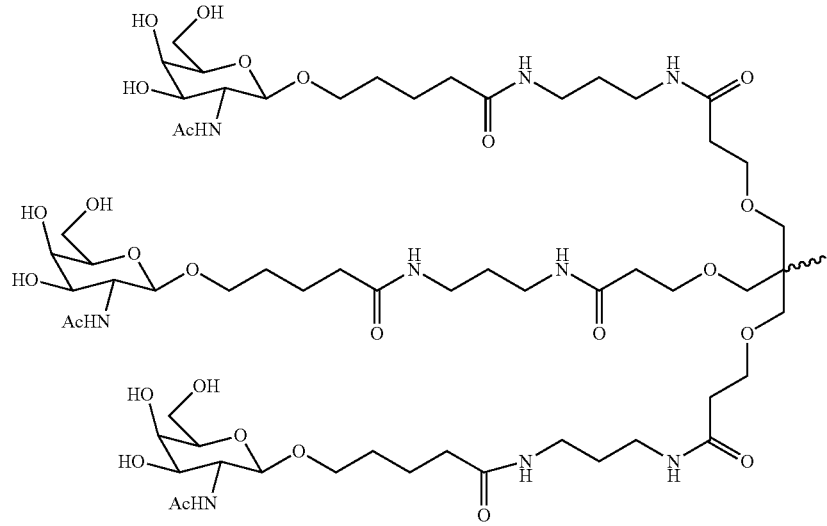

14. The dsRNA agent of claim 12, wherein the dsRNA agent is conjugated to the ligand as shown in the following schematic

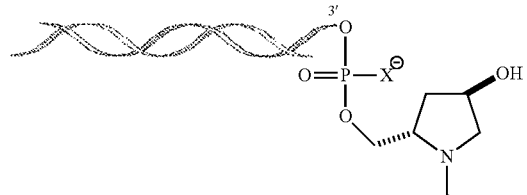

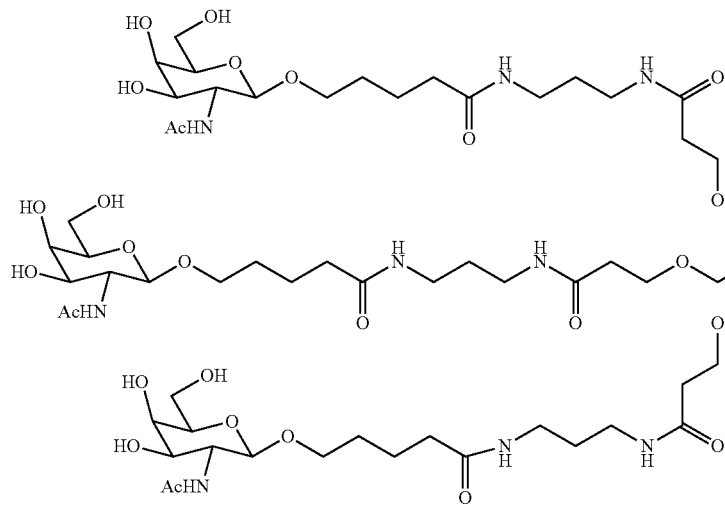

and, wherein X is O or S.

15. The dsRNA agent of claim 14, wherein the X is O.

16. The dsRNA agent of claim 1, wherein the double stranded region is 17-23 nucleotide pairs in length.

17. The dsRNA agent of claim 1, wherein each strand is independently 17-30 nucleotides in length.

18. The dsRNA agent of claim 1, wherein the at least one modified nucleotide comprises a nucleotide modification selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and combinations thereof.

19. The dsRNA agent of claim 1, wherein said agent further comprises at least one phosphorothioate or methylphosphonate internucleotide linkage.

20. A pharmaceutical composition for inhibiting expression of an IGFALS gene comprising the dsRNA agent of claim 1.

21. The dsRNA agent of claim 1, wherein the sense strand comprises the nucleotide sequence of 5'-csasgccuCfaGfG-fAfacaacucacuL96-3' (SEQ ID NO: 184) and the antisense strand comprises the nucleotide sequence of 5'-asGfsugaG-fuUfGfuuccUfgAfggcugsasg-3' (SEQ ID NO: 241), wherein Af is 2'-fluoroadenosine-3'-phosphate, Cf is 2'-fluorocytidine-3'-phosphate, Gf is 2'-fluoroguanosine-3'-phosphate, and Uf is 2'-fluorouridine-3'-phosphate;

wherein a is 2'-O-methyladenosine-3'-phosphate, c is 2'-O-methylcytidine-3'-phosphate, g is 2'-O-methylguanosine-3'-phosphate, and u is 2'-O-methyluridine-3'-phosphate;

wherein s is a phosphorothioate linkage; and wherein L96 is N-[tris(GalNAc-alkyl)-amidodecanoyl)]-4-hydroxyprolinol.

22. The dsRNA agent of claim 1, wherein the sense strand consists of the nucleotide sequence of 5'-csasgccuCfaGfG-fAfacaacucacuL96-3' (SEQ ID NO: 184) and the antisense strand consists of the nucleotide sequence of 5'-asGfsugaG-fuUfGfuuccUfgAfggcugsasg-3' (SEQ ID NO: 241), wherein Af is 2'-fluoroadenosine-3'-phosphate, Cf is 2'-fluorocytidine-3'-phosphate, Gf is 2'-fluoroguanosine-3'-phosphate, and Uf is 2'-fluorouridine-3'-phosphate;

wherein a is 2'-O-methyladenosine-3'-phosphate, c is 2'-O-methylcytidine-3'-phosphate, g is 2'-O-methylguanosine-3'-phosphate, and u is 2'-O-methyluridine-3'-phosphate;

wherein s is a phosphorothioate linkage; and wherein L96 is N-[tris(GalNAc-alkyl)-amidodecanoyl)]-4-hydroxyprolinol.

* * * * *